United States Patent 12,577,609 (METHODS FOR CELL-TYPE SPECIFIC PROFILING TO IDENTIFY DRUG TARGETS) - sequence listing, part 6

SEQ ID NO: 6197 - DNA, 4375 bp, Homo sapiens
  ENST00000368648
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaagccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttc

SEQ ID NO: 6198 - DNA, 2993 bp, Homo sapiens
  ENST00000355311
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaaggtacggccccttcttatctggaaaatgccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtaca

SEQ ID NO: 6199 - DNA, 817 bp, Homo sapiens
  ENST00000440978
cttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggctctctgctgggtgctgaggacgtagccgcggagaagacaaactggcccttttgtgaagtcggtggcatatttcactttgatgaactaatgctcaaaaaaggaactggaaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctca

SEQ ID NO: 6200 - DNA, 2788 bp, Homo sapiens
  ENST00000449079
gcggccgcggcggggcggcgcgggaaccgggccccggggggagtcggccgggctgctgctgctgctgctccaggtgctgccgcccggggctacggcagggccgggacgccggggcacgcggggcgctggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccaaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 6201 - DNA, 444 bp, Homo sapiens
  ENST00000497450
cggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtg

SEQ ID NO: 6202 - DNA, 2705 bp, Homo sapiens
  ENST00000342725
cggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 6203 - DNA, 2012 bp, Homo sapiens
  ENST00000609451
tgagctagacgcccgcagcctcagcgggaccggatccggggcggcgggggcgctcactcaccgcgcgccctcatgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacg

SEQ ID NO: 6204 - DNA, 2861 bp, Homo sapiens
  ENST00000609967
tgagctagacgcccgcagcctcagcgggaccggatccggggcggcgggggcgctcactcaccgcgcgccctcatgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggtatggcgcctccgccctcccagcgccgccgggaccggggccccccagcacgcggcgcccgcggctgccccggccgtgccccgctcttgtcttcgcaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagcccagagagtgacaggcaggtggcttcccaggtggcacatggcttatggctcctttttccttgactactgcagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtg

SEQ ID NO: 6205 - DNA, 547 bp, Homo sapiens
  ENST00000469215
tgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcaggttcttcctcaagttcttcctcaaatgcaaccagaactgcctgaagaatgcggggaatcccagagacatgcgccgcttccaggtggtggtgtccacgacggt

SEQ ID NO: 6206 - DNA, 642 bp, Homo sapiens
  ENST00000463145
ctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgccc

SEQ ID NO: 6207 - DNA, 665 bp, Homo sapiens
  ENST00000491472
cttccccagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggtatggcgcctccgccctcccagcgccgccgggaccggggccccccagcacgcggcgcccgcggctgccccggccgtgccccgctcttgtcttcgcaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcct

SEQ ID NO: 6208 - DNA, 299 bp, Homo sapiens
  ENST00000481662
tgggtcccccagcttcctcaatggctccaccgccacctcgcccttcgccatcatgccctctagccccccgctggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtga

SEQ ID NO: 6209 - DNA, 1647 bp, Homo sapiens
  ENST00000477287
tggcaaggagagcatatttgaggaggaagttggagtgctgtttgtgatgctgggcagagaggcttataacaggagcctgtgcgttcccccaaacttcatccctaactacttgttccagctcttctgtgactcctgaactatgactctagccttggcaccccaagcaaggctcataaatgtttcctagcatctcagaatcccaggggttttcagcagaaatcctgaagtagtccagctgttgctcatctcatttttggggggtacctcccactgtttgttttttttgaatgttctggttttgcttttgtctttacctggtctggccctgtcatccccagccccgagaaaaggtctccagaaccgctgagaggtcagggctggcccaggaccctcacagctcccagtgagatctgagcctggtacctgtgtcagcagcccatgtggggccccagccaagctgctcactctggtgctgtctccctgttgtgtctcccaccaccttccctgctgcgcctgcccctccccgccccgccccggagtcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 6210 - DNA, 2910 bp, Homo sapiens
  ENST00000380648
gcggccgcggcggggcggcgcgggaaccgggccccggggggagtcggccgggctgctgctgctgctgctccaggtgctgccgcccggggctacggcagggccgggacgccggggcacgcggggcgctggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtg

SEQ ID NO: 6211 - DNA, 457 bp, Homo sapiens
  ENST00000494307
atctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaaacggagtctctctctgttgcccaggctggagtgcagtggcgctatcttggctcaatgcaagctccacctcccaggttcacgccattctcctgcctcagcctcctgagtagctgggactacaggcgcccgccaccatgcccggctaattttttgtattttttagtagagacagggtttcaccgtgtcagccaggatggtctcgatctcctgatcttgtgatccacccgccttggccccccaaagtgctgggattacaggtgtgagccactgtgcccggccgagttaaatatatttctaacatagta

SEQ ID NO: 6212 - DNA, 3069 bp, Homo sapiens
  ENST00000372979
caaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcatttctagtttagattactcatttagtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttaca

SEQ ID NO: 6213 - DNA, 1679 bp, Homo sapiens
  ENST00000484976
cagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 6214 - DNA, 2084 bp, Homo sapiens
  ENST00000454759
agtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 6215 - DNA, 2246 bp, Homo sapiens
  ENST00000430082
acacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaaggttggaggtgcagtggcgcgatcctggcttactgcaagctccacctcctgggttcacgccattcatctgcctcagcctcctgagtacctgggacaacagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaa

SEQ ID NO: 6216 - DNA, 884 bp, Homo sapiens
  ENST00000453402
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggc

SEQ ID NO: 6217 - DNA, 877 bp, Homo sapiens
  ENST00000413026
gcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctg

SEQ ID NO: 6218 - DNA, 581 bp, Homo sapiens
  ENST00000610256
aagcgtgagccaccacggccggccgtgagggtggatctttttaaagccagaaatatttgctctttaaagtctcaaaagcaaaactgatctttatggattctggtgcttaattgcagaggtggggaggcagtatgtgtgatggttatgaccacaggcttcggaatcagatcgacatcagttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggat

SEQ ID NO: 6219 - DNA, 5099 bp, Homo sapiens
  ENST00000415912
gagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggagggc

SEQ ID NO: 6220 - DNA, 3763 bp, Homo sapiens
  ENST00000357071
gactctctgatgtttgggagcagatccgagcagctgagcagggtggctgttcctttcctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaaca

SEQ ID NO: 6221 - DNA, 653 bp, Homo sapiens
  ENST00000531334
gaagaggctggagcagaaggtgtaaatgtgagagccatcagtgcgtagaaggtattttaagccatagggctaaacgagtgcacatcaagaagagggctcccctaggctgagcccaggcccagatccccagaaactagtccttgccccaacacgggggagctccctgagacctccataccagtcccctccttcaccacctgccatgggaacccctgagctttggttttctctcctcccaggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccga

SEQ ID NO: 6222 - DNA, 2484 bp, Homo sapiens
  ENST00000374893
aggtggtgcaacgcctggcccggcccatcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacc

SEQ ID NO: 6223 - DNA, 2328 bp, Homo sapiens
  ENST00000436918
catcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatcc

SEQ ID NO: 6224 - DNA, 2381 bp, Homo sapiens
  ENST00000264205
ggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagc

SEQ ID NO: 6225 - DNA, 2172 bp, Homo sapiens
  ENST00000526194
atcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtgagttcccccaggccctgccggcaaggtgccagctccccacctgtgggcaagccttgggacgaactggccttcattgcaccctcactgtgcacccgatcagctatcacgagagccgtctgaagagtggatgcccttgttatcccacttttcagatgaagaaaccaagggcaaaagaagtatggcccagctaggagctgggatgggcttgagcctgcccagcctgttggcagggtgagcctggcctctggagcggagccgatctggcaccttgtctccgctccactgctttgggatttggagccttcatttcattttccgcagaataggatgggaggagctggttctggggtcctcatggcagtcaaatgtgaggacctctggggagcgccagaccccaaggaggccccagcaagagcagctttcccattgttcctcactaccacgaatggt

SEQ ID NO: 6226 - DNA, 486 bp, Homo sapiens
  ENST00000470394
cttccagaacaaagcatgggccccacatggtgctacctcccagcaagaaaggggttgggaaacaaagggctggggcccagcgagccccctgacttgtgttttccagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccc

SEQ ID NO: 6227 - DNA, 576 bp, Homo sapiens
  ENST00000528294
acaagccctggaagacagggaccagcccaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgag

SEQ ID NO: 6228 - DNA, 674 bp, Homo sapiens
  ENST00000473505
gtttagctagactgttaggctggagggatttttcctccctttcaggacctgaatggagctatttctccttgcatctctgccaacatctcccaggatccacctctgatccactggtgggctcgggcatcaacagctttgggttccaatcccagctgtccccattcagctgggtggtgagaagccagggtctcacctctctggacctcagtttcctcacttgtaaaaagaaaaataacaaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatc

SEQ ID NO: 6229 - DNA, 578 bp, Homo sapiens
  ENST00000481130
aggacatcacacaggagcacaggagcatgaggaggtgcaggggcatctgtgggtagccctggagtcaggaccagctgctttctggtctgctttgcagtttgtgcttggagaagatcagagtggacaactcagccccttaaacccagctgggaggtgacacctgaagtcgtaaggatggagcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggacctt

SEQ ID NO: 6230 - DNA, 580 bp, Homo sapiens
  ENST00000527991
agattcaacccagatttctcctccacggctgcacagtgccaggaagggaactgagaagaccaaagtggaggttctttaccttccccaacacactcggggccaggcgtggcacccacaactgcaaatgagacaattagggagaataagtgctggctgccctgtcagcccagagcctcagtctgcccagggcacccagactctgtgaggttcccacctgaagaagcagttccatcttccacaaggagcacaggaccaagagtccaggacccagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggac

SEQ ID NO: 6231 - DNA, 507 bp, Homo sapiens
  ENST00000463334
tggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtg

SEQ ID NO: 6232 - DNA, 1509 bp, Homo sapiens
  ENST00000371522
gaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcac

SEQ ID NO: 6233 - DNA, 2645 bp, Homo sapiens
  ENST00000460612
cttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 6234 - DNA, 5817 bp, Homo sapiens
  ENST00000539680
tcttttttttttttaagcttcatcatatataaatgaagagtctgatgctattgcctagacaatattaatgctgtcaagtttctattatacttggttagaaagtctccgaactaatacagaactctgggtcactcaatggagtggctgattgcagctttcatatctagacctgtagactatagggtttgtctttttgccttaactaaataacaatcacaaaataattcagatttccaaatatactaaaatattggtactatataattactgatattttcagtacttaaaagtagctttgtataccaaaacaccagtctaccaaaaacaagtactggcatgagtaatcccagagttgagaccttctgggtcaacctgaaaaacaaaacttcaacttccacctatgttactgggtgctcagaataaaggtttccggataggagagggccagggatggtgtagatggccaccatctagtggacaaaccactctgatagggtagcaaatggttccagagttttctcagcccagaaaaaaactgtcaatatccacagtttgcatcagatttccttcttaaatagtaaatacacattacactttgagaaatggattcagctgtgttttttttcttttctttttagagacaggatcttgctctgttgcccaggctggagtgcagtggcacgatcatagctcaccacagccttgaagccctgggcctgagcagtccttccacctcagcctctgaatagctgggactacaggtgcaagctactgacttggctagaatttggctgttttcactcacaaacatacgtacataccgtttttaactttaataaaaggttactttatttatttatttatttatttatttatttatttttgagacagggtctggctcttttgcccaggctggagtgcagtggcatgatcacagctcactggagcattgacctctcaggcccaagtgatccttccacctaagactactgagtagctgagactacaggtgcaagtcaccacgcccagctaattttttattttttgtagagatgggatctcatgatgatgcccaggctggtctcaaactctttgggcaagcaatcctcctgcctcagcctctcaaagccctgtgattacaggcgtgagccactgcacctggccaagattacttcctttattgggtagttacctaaataataacacatatggcaagcaaatctaaaagaacagaggagtaagaagggcataaggtaaaaatcaaaggcaagatgaccagctagtcctggtttacctgtgactaccccagttttaaaagtggaagtcccatatcccagtaacccttcagtcacaagcaaacccaaacagcccttcatttcccaatccctctctctccccagatcatcactattgtttccatactcttccagaaatttccattgcatatggaaggacgtgtattatgcacatatgcttacatatttaaataaattccttttaatggcttagaggacaagaaatatctttcgaggctaatctgtttctaacaaattttaaaaacaaaatttaaatatgcatagtaaggaattcaaacatggaagaatataaaacaaaaccttcattttatataacaaaacatttataaaccttcgtttataaaacaaaacaaaggtttggttttgttttataaaggcacaccagcattttgccagtttttgccaaattgctctcctgtggcatactcttttacttttctatcaataatgtatgtaaatactggtttccccagtctcggcagtagtaggcatattgatattttagtatttgctggtctgaggtgaaagggcacagtacctcactgttttgatttgcctttcaagcgtgtagcagctgctggacatccttcacgttcgtacttcttttccggtggaccttttacatactcttttgtaaatggtttaaaagttactttatactaacttttttgtaaatcaaggaaattcatctgtcataagcattgcaattctttttcccagttttttttttttttgagacttttcctgagaaagttttataaacacttcaaataatatgatataggaagtaattcctccttgcctggaagtggggctgagactggagtgctagggctggtgtggaaccaaggccagtgacaaagcagacactgttgcttctatgtggctgtattaaaatgcacccgcccctctgcactgccccacagaccaggatttcaacacagccctgtcgacttgaaagcccaagttcctaaccctgactttgtttcactctgctggggtaaaaccttaccgcagaggctggcatttgctgaaatgaggtcgaggaagtgggaaaggtggttgggagtccaatccaagtctcaccaatgattggataaacacagccaagtgcttcacctccctgcactgcaatctcacagctgtaaaatcacagctgggtcatcagtgatgacaccagcctagaagtgtgggtagcaccattagatgagtctgtgggggaggaaagcactttgtaaactagttatgttgtgcatgttggaaggatgggctgaataacaagaaacccaggtgttcagggatcagagtctggcttctttcatgatagaaaaagaacctcagctaacaggttataggactaacgctaaagaaactgtcagcagaatggctggaaccagacccagacatctgcctccctcctttaaaacaaagctgtgcacctcagacctgcaactatcagccttgatgccctcctcaaccaagactttttgcttttccctaggcccccattgccgtgcggctgggcaaagtagccattgaccgaggaacggaggtgagagggttttgggttgggacttgggtccactaaagttggtcgcggctgggacacagtgctttcagagctcagacagcacagctgggaaaaactcaggaagtggactcttctaacagacttgaactctgacctcgtgctctacgtcagtttacacatctgcaaattggccagacagtattattgtttacattctatcctcatctttctcccttggagagaggatgagattgaggttaagaaagggtaaatgatttgcccaaggtctcagaggaagtgagtagaaagaacccgggtctgtgtggctgccagtccatgctgcaagatttgtgctggcagtaatgtggcctcagggcagggcttggggtgatgccttgggtgtggctaatccatctgtccacctcaactctcccatctagttaatccatctgtccacctcaactctcccatctagtcactcatcacacactgaatccagaacaaagctgggaactgggatacagatggatgagttaaacatggtcactgcccccgggagggggcagatacagacacaaatcaaggataatggtaccacgctgacaccccagaaaggttagagctttgcggtccattatgatatccatgtgtggcttttaaattaaaagtaaaatgtggtcaggcgcggtggctcatgcctgtagtcccagcactttgggaggctgaggcgggcgatcacgaggtcaggagatcgagaccatcctggctaacacagtgaaaccccgtctctactaaaaatacaaaaaattagccaggcgtggtggcaggcacctgtagtcccagctactcaggaggctgaggcaggcgaatcgcttgaacccaggaggcggagtttgcagtgagccgagatcgcaccactgcactccagcctgggcgacagagcgagactccgtctcaaaataaataaataaataaataaaataaaatgttcagtttctccttcacgctaatcacagttcacgtgcttgacattcacatgcggctagtggctaccatactgggcagtgctcggttaaagactgttttctacagttggactgtgggaaggataaaaattccagaggaaaagtatgggcaaaggcacagaggaggataagcaagcagctcgtccagatgagagtgagggaagaagagagagtgcaagttcgaggcactaggctgtctgggttcaaagacctgctcttccacatactgttgtgaactttgacaaattatttcacctttctatgcctcaggtttctcagctgtagaatagggatactaacccttgctgtgaaaattaagttcacacacacatggtacttctcttagaatgaggctttcaagtgccagtcagtgggccctagaggctggagcaattgccagggcccaggtcataaaggttcagaaattaacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcaggtggacattgcatctgggatggccattgaagggatgtgctatgcccaggtatgtagcaaccagcccatgcctgcttgttaacataggctgggccaggctagagggactttgtatggtacatgaccaattttagaaggttcttctcaacacaaacagtctgaccgcatccatcgtccctcataagtcacctggagtggcttgaggagagccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatcagagtccagagacaatggaaacacttggaccctggccttgtcttgggctggacaagcttaagcaactctttttgggcctgtggccctgctcccccaaaactaatattttgtaccttgttgcagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctct

SEQ ID NO: 6235 - DNA, 2356 bp, Homo sapiens
  ENST00000479183
ctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtgagagggttttgggttgggacttgggtccactaaagttggtcgcggctgggacacagtgctttcagagctcagacagcacagctgggaaaaactcaggaagtggactcttctaacagacttgaactctgacctcgtgctctacgtcagtttacacatctgcaaattggccagacagtattattgtttacattctatcctcatctttctcccttggagagaggatgagattgaggttaagaaagggtaaatgatttgcccaaggtctcagaggaagtgagtagaaagaacccgggtctgtgtggctgccagtccatgctgcaagatttgtgctggcagtaatgtggcctcagggcagggcttggggtgatgccttgggtgtggctaatccatctgtccacctcaactctcccatctagttaatccatctgtccacctcaactctcccatctagtcactcatcacacactgaatccagaacaaagctgggaactgggatacagatggatgagttaaacatggtcactgcccccgggagggggcagatacagacacaaatcaaggataatggtaccacgctgacaccccagaaaggttagagctttgcggtccattatgatatccatgtgtggcttttaaattaaaagtaaaatgtggtcaggcgcggtggctcatgcctgtagtcccagcactttgggaggctgaggcgggcgatcacgaggtcaggagatcgagaccatcctggctaacacagtgaaaccccgtctctactaaaaatacaaaaaattagccaggcgtggtggcaggcacctgtagtcccagctactcaggaggctgaggcaggcgaatcgcttgaacccaggaggcggagtttgcagtgagccgagatcgcaccactgcactccagcctgggcgacagagcgagactccgtctcaaaataaataaataaataaataaaataaaatgttcagtttctccttcacgctaatcacagttcacgtgcttgacattcacatgcggctagtggctaccatactgggcagtgctcggttaaagactgttttctacagttggactgtgggaaggataaaaattccagaggaaaagtatgggcaaaggcacagaggaggataagcaagcagctcgtccagatgagagtgagggaagaagagagagtgcaagttcgaggcactaggctgtctgggttcaaagacctgctcttccacatactgttgtgaactttgacaaattatttcacctttctatgcctcaggtttctcagctgtagaatagggatactaacccttgctgtgaaaattaagttcacacacacatggtacttctcttagaatgaggctttcaagtgccagtcagtgggccctagaggctggagcaattgccagggcccaggtcataaaggttcagaaattaacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattaga

SEQ ID NO: 6236 - DNA, 555 bp, Homo sapiens
  ENST00000543419
agctgctggaaactctggcccagctgcgggaggaccggcaagtgcgtgtcctgctcttcagaagtggagtgaagggcgtgttctgtgcaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattaga

SEQ ID NO: 6237 - DNA, 663 bp, Homo sapiens
  ENST00000463923
atctaactgggtgtcctctgtagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattaga

SEQ ID NO: 6238 - DNA, 1606 bp, Homo sapiens
  ENST00000371520
gaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattaga

SEQ ID NO: 6239 - DNA, 1126 bp, Homo sapiens
  ENST00000358358
agccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattag

SEQ ID NO: 6240 - DNA, 985 bp, Homo sapiens
  ENST00000498544
agcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaatta

SEQ ID NO: 6241 - DNA, 1676 bp, Homo sapiens
  ENST00000476477
aatttgcggacttgggcatgggactgagtcaacctgtccccatctctgatcctgtgcttaggttctgtacggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagacaaagctgaggaccctgggagataataataaggggtctttgaaggccaaaggattgggaaacactcctctgggcacctgctggatttcagccctgggaagacctgaaatgtccatcctgatttttcgtaggaggagaaacagcctagaagggatgataagggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcaca

SEQ ID NO: 6242 - DNA, 766 bp, Homo sapiens
  ENST00000479593
gaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaa

SEQ ID NO: 6243 - DNA, 702 bp, Homo sapiens
  ENST00000467988
cggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtggacattgcatctgggatggccattgaagggatgtgctatgcccag

SEQ ID NO: 6244 - DNA, 940 bp, Homo sapiens
  ENST00000487866
ctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggag

SEQ ID NO: 6245 - DNA, 474 bp, Homo sapiens
  ENST00000486170
aagaaaaaaggaaaaaaaagaggccgggcgcagtggctcattcctgtaatcccagcagtttgggaggctgaggcgggcggatcacgagcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacg

SEQ ID NO: 6246 - DNA, 471 bp, Homo sapiens
  ENST00000487851
acaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggagggactcagaggctgccccgttgtctgggggtggccctggcga

SEQ ID NO: 6247 - DNA, 631 bp, Homo sapiens
  ENST00000488268
cggcgcatgacgcgactgggactaggccggaggcagcgggggaccggcagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggcccc

SEQ ID NO: 6248 - DNA, 1335 bp, Homo sapiens
  ENST00000544365
agcgttctctagcccttaggcagccgaatccctaatttgcggacttgggcatgggactgagtcaacctgtccccatctctgatcctgtgcttaggttctgtacggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggtgaggatctgggtgtggggtggaggagggggtttgggggtccctgccgatgacagtcccgctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctg

SEQ ID NO: 6249 - DNA, 456 bp, Homo sapiens
  ENST00000495920
gcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttc

SEQ ID NO: 6250 - DNA, 370 bp, Homo sapiens
  ENST00000492992
ctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggtgaggatctgggtgtggggtggaggagg

SEQ ID NO: 6251 - DNA, 804 bp, Homo sapiens
  ENST00000480312
gggactaggccggaggcagcgggggaccggcaggtgggccgctcagtgcgttgaaggattcgatccccagtccctccctcccagttctaggcgccccaaaccgctccaggcctgagaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggt

SEQ ID NO: 6252 - DNA, 548 bp, Homo sapiens
  ENST00000544531
atccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggt

SEQ ID NO: 6253 - DNA, 714 bp, Homo sapiens
  ENST00000493896
taccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattagccgggcgtggtggcacatgctgtaatcccagctactccggaggctgaggcaggagaatcgcttgaacctgggaggcggaggttgtggtgagccaagggatcactgagattctgatgaacagaccttctgcccgcaatgccttggggaatgtcttcgtcagtgagctgctggaaactctggcccagctgcgggaggaccggcaagtgcgtgtcctgctct

SEQ ID NO: 6254 - DNA, 557 bp, Homo sapiens
  ENST00000487040
aaaaaaaaaaaaaaaacagcaaaactctcccccgccaaaaataaaaaaaaaaaagatgaatatggagggagttgtaaaattaaagaaggtacatgggtgcatgtgtgcttgtgtgtgtgtgtgtctgtctgtctaacaacagcagaagcaggcaagggctactgtggtagtcactgttgttcctctccccattttgcttcacagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctc

SEQ ID NO: 6255 - DNA, 981 bp, Homo sapiens
  ENST00000542552
ataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagctgggcactaaggttctccaccacaagctgacctttccatcctccctcctctacccatgggctcatttgaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccattttgctgtgaccctaaaactgctctaagaaaatcatctatttataaacaaataaatattcttctaagaagccaaagcagaaaacgatcaagtggagtgtgttaatgtcagcaaaggtttttgctgccacgaggttgaggcaaggagagaaacgtgtcccttggttagtgatgtggctatattcatcactttaatgagaataatgtctgctgagtg

SEQ ID NO: 6256 - DNA, 545 bp, Homo sapiens
  ENST00000474789
agacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtg

SEQ ID NO: 6257 - DNA, 1446 bp, Homo sapiens
  ENST00000536120
aattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaa

SEQ ID NO: 6258 - DNA, 978 bp, Homo sapiens
  ENST00000434243
cggagagcctgggggttggggacgatgggctagttcctgctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccc

SEQ ID NO: 6259 - DNA, 6146 bp, Homo sapiens
  ENST00000256497
ggctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaattttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttgggtggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggttgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatactgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcagtgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttg

SEQ ID NO: 6260 - DNA, 1956 bp, Homo sapiens
  ENST00000465369
gccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtacttactggctaaagctatgtgctggacattgtgcattcccaggatgcaaacgctgtcagaaccaaaggatattactatcttctttcatggtttccaaccttgttgaaaa

SEQ ID NO: 6261 - DNA, 730 bp, Homo sapiens
  ENST00000443790
gcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggaccctttgagagcatgatttctaccgaagcaaggggacatcccaagctaaattcaaaggactgagccttttcaaaattctaggaaaccgatgagtttttcttgcttaaccatagcgtttatacgtataagtgtattttctatctcaatttttttgagaaaaaatattaaattttgaaaaaaaa

SEQ ID NO: 6262 - DNA, 585 bp, Homo sapiens
  ENST00000465187
atgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcagta

SEQ ID NO: 6263 - DNA, 1363 bp, Homo sapiens
  ENST00000445686
acgcgcttccttccgccctccgcgccggggtgcagccctctgtcctccggggcccccgagggcgccagggccgttagggtcccgggcagcgctcccgcgccctgtcccgtttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtac

SEQ ID NO: 6264 - DNA, 307 bp, Homo sapiens
  ENST00000492751
aaataagagttgctggcaattatagtttctgatgggtgtttacttttattgtcttctcttttgaaataaagtctttttgttgaattttaattttctttttcagttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctca

SEQ ID NO: 6265 - DNA, 4727 bp, Homo sapiens
  ENST00000296591
agaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattcttttgaagcagttgtaattaaacacatttataagaata

SEQ ID NO: 6266 - DNA, 4244 bp, Homo sapiens
  ENST00000380138
ggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagc

SEQ ID NO: 6267 - DNA, 1353 bp, Homo sapiens
  ENST00000510271
gacctctgtattcaacattcctatcacttttgtaggtaactgtgctattgcataatatggccatacttaagtcattttccttgagaatagagaagtaaaggagaaaccaatgatttttcccccacttcagatctcacctgccagcactgatgtaagacttcacctccctatttcaaggcacattattatcatcagtctggataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggagaactaaaggaaaggttttcaaaattaagtgaccaccaggccactggaaacatttgtcaatatgaaggattattctgatttccaaatcacagttccaatatttctcatttatgaaggttcacctataaagaagatctaaaagaggtcaagtaatgaaacttgtatatgattgtgagacagcttccgttcttctatagtattgacatatgttggagtgtgctaagtgaatcgaaggatgctcacactttcctaggactataagtcatctttatgtattttttcatttttttaaaccacataccatgaataagaaatctttttgatttttataattttatgatgtcaaagggaatccccactatccaattagaaaaaagaactttttataaacaaaacaaaattgaaaggacatttgtacagaaaatacttaagtgcaaacaaaagtgcagccaatatcaatgtagtataaggagtgcataatttgaggtacaaaatatagatgtgagggctgacaaattatatcaatactctgagacttcaatattctttctttttttatgtaaaatggagatactacaaaaaaagatcagccccagcctatcttctccttttaaaattcctcacacaagtaaaattctggtgtctaaatcatgactggacgaatc

SEQ ID NO: 6268 - DNA, 558 bp, Homo sapiens
  ENST00000507663
acactttcattagcagccacaggtactaaataatctgctgttactttctcaagtttaaaaatgaccatcagcccctcttctctaagtatgcaacttttgacggactgctcgttttagattggcagaaaatgtgcttccccagaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggc

SEQ ID NO: 6269 - DNA, 4471 bp, Homo sapiens
  ENST00000377211
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 6270 - DNA, 4277 bp, Homo sapiens
  ENST00000334286
atcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctgg

SEQ ID NO: 6271 - DNA, 1571 bp, Homo sapiens
  ENST00000626030
gtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcac

SEQ ID NO: 6272 - DNA, 643 bp, Homo sapiens
  ENST00000475537
attgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcag

SEQ ID NO: 6273 - DNA, 3815 bp, Homo sapiens
  ENST00000194130
tttatttggaggacactattgaagccacctgctcaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttttttttttttttttttttttgagacggagtctcgctctgtcgcccaggctggagtgcagtggcgggatctcggctcactgcaagctccgcctcccaggttcacgccattctcctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaattataa

SEQ ID NO: 6274 - DNA, 2861 bp, Homo sapiens
  ENST00000427975
actattgaagccacctgctcaggacaatgaaattcttcagttacattctggtttatcgccgatttctcttcgtggttttcactgtgttggttttactacctctgcccatcgtcctccacaccaagagtaagttgtaataacgatatcggatgtatcagcaacttccagcagacttgggggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaa

SEQ ID NO: 6275 - DNA, 2457 bp, Homo sapiens
  ENST00000439260
ctattgaagccacctgctcaggacaatgaaattcttcagttacattctggtttatcgccgatttctcttcgtggttttcactgtgttggttttactacctctgcccatcgtcctccacaccaagcttattctgacttttccaagatgaagatgaagagcaggccagtggcatgggccagatgcagtcagatgactgactgaccaggagggcctccgtccagtgaccagtctcagaatttaaaggacccttcccccttacttatgcttgtactcagcccaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacc

SEQ ID NO: 6276 - DNA, 2222 bp, Homo sapiens
  ENST00000539873
ccagcctcataatatcaccttttgctttgcatttgttcttaccaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacc

SEQ ID NO: 6277 - DNA, 3024 bp, Homo sapiens
  ENST00000394555
agatgctgtgttcccctcctcagagaagaagaaaacgcactagagagtgggagcatccccaaggctgaagcgcatccaggacatcacatgtcaacgtgtcctctctggcgtggggtccccgcgagtctgggaaacgaggagctggcaagggagggcaagcgggggcggcaaagagggcccctggagcagggggcgcggacctcgctgcgctgcgcgctctaccgccgggctcgcaacgctgggctcagcgctcgcgcctccctcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatca

SEQ ID NO: 6278 - DNA, 1809 bp, Homo sapiens
  ENST00000635671
acggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttag

SEQ ID NO: 6279 - DNA, 1820 bp, Homo sapiens
  ENST00000355426
agatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaa

SEQ ID NO: 6280 - DNA, 1007 bp, Homo sapiens
  ENST00000634374
aaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgt

SEQ ID NO: 6281 - DNA, 733 bp, Homo sapiens
  ENST00000438672
gacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaag

SEQ ID NO: 6282 - DNA, 563 bp, Homo sapiens
  ENST00000452161
acggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacc

SEQ ID NO: 6283 - DNA, 572 bp, Homo sapiens
  ENST00000439193
acttcgccagatcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtg

SEQ ID NO: 6284 - DNA, 559 bp, Homo sapiens
  ENST00000440439
agacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagc

SEQ ID NO: 6285 - DNA, 558 bp, Homo sapiens
  ENST00000429909
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaa

SEQ ID NO: 6286 - DNA, 552 bp, Homo sapiens
  ENST00000452337
atcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgt

SEQ ID NO: 6287 - DNA, 547 bp, Homo sapiens
  ENST00000421664
acttcgccagatcagacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtccc

SEQ ID NO: 6288 - DNA, 588 bp, Homo sapiens
  ENST00000480016
ggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacggtaaggggtgatggaatttgaaataagtacggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttcaaaaactaaaaccaaagaaagttacatgtttccaaaacattcaacaaattaatgggtgtaaggaactggaaaacctggactcctaccacatgcagataaaaccaatacgtgcagaataagactcaagtcaagtaagaacgttaaacaccataaagac

SEQ ID NO: 6289 - DNA, 339 bp, Homo sapiens
  ENST00000424207
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacg

SEQ ID NO: 6290 - DNA, 604 bp, Homo sapiens
  ENST00000497698
agacccacggggctgccctcccctgcgcactcccctcgctgcccgggcccggagcgcagcgcggccgcacaggtatttttgctgtgctgtgcaaggaactctgctagctcaaggtgagtatactgggaaagccttaacgttctagagaacagagttttgcagccccacctccatcccccggggtgtgggactggggggcaggaaatgcaccgtcccctttgaaatggattactgttttttcctttcgaccccctctttctgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgact

SEQ ID NO: 6291 - DNA, 1484 bp, Homo sapiens
  ENST00000343571
atctcactcatttgttcatatattggtctctgaggtcccttctaggctctgacaactggaaactctgaaaatagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcttaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgta

SEQ ID NO: 6292 - DNA, 2464 bp, Homo sapiens
  ENST00000420999
gggggccaaacaacacggccgggaggcgccgctgcctgccgggccctctcttctgggaccctggattttcggacactgagcgccatggccctgcctctgctgccgggcaacagcttcaaccgcaacgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaa

SEQ ID NO: 6293 - DNA, 1156 bp, Homo sapiens
  ENST00000409613
gctaagtgcaggcggataccccggccttggcggctgcttgcctttctccgtactgtccctgtgaaggccaagatctgtaacgctgacagtccccagacatacgatgggagagttgcagtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggcccctta

SEQ ID NO: 6294 - DNA, 2259 bp, Homo sapiens
  ENST00000264059
cccagcctgtcccgggccgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatctta

SEQ ID NO: 6295 - DNA, 843 bp, Homo sapiens
  ENST00000442845
ggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaaga

SEQ ID NO: 6296 - DNA, 1817 bp, Homo sapiens
  ENST00000409708
actctacagcgtgtatccgtggctgtaacgtgagctggtggagcagtcaaggttagacaggaaattttaattaccctggacttatctggaggcctctttcaaagggaggcaatgagggcagccacttaaaggcaggaccccaatgcaacatcttaaaatgcagccgcaaggtttttgcagcatactaaaagcttgtgttttaattccccaaagagagggtgggaagaggaacatttggctatgggaaagttgtctttttcttaagaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 6297 - DNA, 541 bp, Homo sapiens
  ENST00000427698
gattacaggcgtgcaccaccatgcccagctaatttttgtatttttagtagaaacagggtttcaccatgtttgccaggctggtctacgaactcttgacctcaggtgatccgcccgcctcggcctcctgaagtgctggaattacaggcatgagccaccacgcctggctggatataccccgtttcgtttctcctttcatctgtccgcagacacccgcgttgtttccaccttttggctgttgtaaactgatttgtttttagagcaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaag

SEQ ID NO: 6298 - DNA, 1538 bp, Homo sapiens
  ENST00000410095
aggaattacatgtttcggagactaacgagtgtcctttcatcccggtcatgcattcctttgaccctgcaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcc

SEQ ID NO: 6299 - DNA, 1490 bp, Homo sapiens
  ENST00000611312
atgtttcggaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatctt

SEQ ID NO: 6300 - DNA, 2419 bp, Homo sapiens
  ENST00000375980
aggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctatattcttatgtg

SEQ ID NO: 6301 - DNA, 899 bp, Homo sapiens
  ENST00000445566
gaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctgggctccccggacaggaagcagaggatcaggatggcagcagcttgagcgactcccttcgagcgcccttgctttgcagcagccacagaatataggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctcc

SEQ ID NO: 6302 - DNA, 349 bp, Homo sapiens
  ENST00000505499
gagaagggagtagacaactgttcctgagggaaatctgggaagggttcatggagctgattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatct

SEQ ID NO: 6303 - DNA, 4933 bp, Homo sapiens
  ENST00000611503
aacagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagccttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaactttttttttttttttttttttttttttttttttttttaagaaactcaaagaggcatttttatgaataaagtgaccttccccaaggctgacaagccagggttgatgagtgcatagtggaatagctttggatactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgttgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattgga

SEQ ID NO: 6304 - DNA, 5335 bp, Homo sapiens
  ENST00000333274
gcttctctccatcttgtgattcctttttcctcctgaaccctccagtgggggtgcgagtttgtctttatcaccccccatcccaccgccttcttttcttctcgctctcctacccctccccagcttggtgggcgcctctttcctttctcgcccactttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagccttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaactttttttttttttttttttttttttttttttttttttaagaaactcaaagaggcatttttatgaataaagtgaccttccccaaggctgacaagccagggttgatgagtgcatagtggaatagctttggatactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgttgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattgga

SEQ ID NO: 6305 - DNA, 606 bp, Homo sapiens
  ENST00000510359
cttgaaaaggagaagaaagtttcttcctcaagtgatttataacttgaaacatgctgtcatgttttgcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaa

SEQ ID NO: 6306 - DNA, 931 bp, Homo sapiens
  ENST00000504941
atcttgtgattcctttttcctcctgaaccctccagtgggggtgcgagtttgtctttatcaccccccatcccaccgccttcttttcttctcgctctcctacccctccccagcttggtgggcgcctctttcctttctcgcccactttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctgtgagtatatagagatttatcgtgttgtagggcagctgcaagaacccagactaattttttacccatgtttcagagaattgcagagagctggactctgcattacagatatctccttgtaaatgcgtacatcaggatccctagatacattagctgggaattgagagcacaaattagattaaagacagagcgcgtctccccctatgaaattacgtgtcagcctgttcactgaaccactgctgac

SEQ ID NO: 6307 - DNA, 637 bp, Homo sapiens
  ENST00000509503
gctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatgacaccgtacatgagtcagccgagccatcccgcggcgagaacgcggcacaaacaccaaggatacccagccgccttttggcaatcctactgttcctcctggcgatgcttttgacattatagcacagtctcctcccatc

SEQ ID NO: 6308 - DNA, 3222 bp, Homo sapiens
  ENST00000226091
ggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgctgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcggggtatgccgtcacctcagtagttttactgtaaaagggaaatttgaacaacaaaaaccaaaaaaaataaaaataaaaaacttcaaaagttgacaagaa

SEQ ID NO: 6309 - DNA, 5162 bp, Homo sapiens
  ENST00000401432
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggaggtgagtgtccgtgccaccgtcctggggcagccccacctcctgtagattggacgctggactccaggctcccctgcctgcatagtgggcttaaggctgcatggaaagcaagtttctcgagtaattccacacttgtactgactctccccacgtatgcgtcatagatacttcccttcggaaaaattgttagggtcctccctgctcccatgaggatatcataaaactcactcttgaaaggcctggctggggatggtggctcacacctgtgatcccaacattttggaggctgaggcaggaggactgcttgagcccaggagtttgagatgatctggggcaatataaggagaccccatctctacaaaaaataattgaaaaatcagccaggcatggtgacgtgcacctgtggtcccaggtactcaggatgctgaggtgggagaatcacctgagcctgggaggtcaaggctgctgtaagccatgatggcagcacggcacttcagcctaggtgacagagtgagacctcgtctcaaaaaattaaaaagaaaggcatgctggtcatcattccccactcacagggggaccgatatgctctgggttggaaactagaagacttaactggagagataagggtgagaacagctttcatagtgttgcttccgtatgtatcaataaagaatctttttttaaatttacactatttttaaagcaattttagttacagcaaaattgagaggaaggtacagagatcgccctttgccccctcccctcccctgacacatgcacagcctcccctcctatccatatcccccagcagagtggtgcatttcttacagttcaacctgccttaacacaacagtatcatctgaagtctgtcgtttacactggggttcgccctcagcgttgtacattctgtgggtttggacaaatgcgtaatgacatgcatcccccaccagagtaccatacagagtcatttcctgccctaaaaccccctgtgctccacctcttcatctctcccctaaccactgacagccaagatgttttttttttttttttttttaatgctgactgttacagttcacaagaagtacggaggacacacatctgggtgggaccgggacagaaagacttacatggtcctcaggcatggacaggctggcattccccagcctctctgcccattagggctgatatagacatggaggacagctttgacatcaagcctttccccagatgcaatcagaggtaggagaagtctctaggggtcaggatcaagcctccccctaactgtgccctcgaccacttcatttattggggcagatctctaccccagggccctcaaagcttatccagaaccttcccacggaaggaagctctgacttgggctaattggacaagtaaaatgaggttgaacgaggcatcctccatggcccttccagctccaaggactgggaacctccaatgcgttaggcatcggggtgagttggctgctctctccccatagtggcgattctcccttcccaagaggtaagagaccctcgggaattgaggagtgaagtgactcagaagcgcaaggcgaaatgcttacacagctacagagccacctcctcactagtggcctcctgggccaccagtatcagttccttcctcccttcaagagtcagcttagcccagaggtagcttggtggcaaagcaggggtgcaggggccttcatcctgtgcccttctgccatgccacaactctctccactctcagccatcagtgccagtccagagtcccacggtggttcctagggccgtactgcccagccttgccgcaggggtgaataaatgcttgtttggtcaaatctgaatcctggtgcctggcattcccagccatgcatagtctgggctctgccatttcatttttccccacctgctctggcccgtatccactgtcccactctggtggggctgctctcgatctctcccacgctgcgctccgccatctccaggcctttgctagtgcagaatgccacatctgaaccacccttccctccacactggtgcagctgagcgcctgtgaactgtctgttctccagcgcccggcccctgttcagtttcctcataaacttctctctccctgctcttgcccagggagcatcccttctctcttgcccagagagcggcattttctttgactgttgccaccacacagttccctagcaccctgcaggtgaatatccaatgttgctcggtgctgacagtggatgaatggatggacgtacagaggataagtcctcagagcgagttaaagccgagcatagctctctcttgcatgtaattcctatgctagcaaattgtgcagtttctatagactcacctacagtcctgcatgtagttggtgctcacttaatgtttgttaaatgactttatctcatacatatacttctgtcctctcctactcaaacaaaaatgccaaacaaatcaaaaaatgcacgactcagtgaattttcataaagtgtgtatgcccacgcaaccacgcctggatgagagagtggaacactgtcatcatccaggggccctgcctctgtgccccctcccctaagggagctcccagcctgagttgcgttacttctggaactttatatcaatgaaatcattctgttctgtgtctgctgcttttgcttaagattatgtttaaatgatagagcatgaggctgggcgtggtggctcatgcctgtaatctcagcactttgggaggccaaggcaggtggatcacctgaggttaggagttcaagaccagcctgatcaacatggtgaaaccccgtctttactaaaactacaaaaaattagccgggcatggtg

SEQ ID NO: 6310 - DNA, 7434 bp, Homo sapiens
  ENST00000403714
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacctaatattggaatgatttcttcactctctggacaaagtctgggacatcagcaccacctggcaacgcttgtggcttgggaggagccatggagacccctttgggttctgggttcctgttttcctggtgtgccgtctgtgtctctgtgtaatgaggatgtgcagagaggagctaacgcggagccgggcagagccacccaggaggcagtttgttgccttctttgccaattccccttcccggcccctcctccaggtgcctttgtgtctcccggggtgccactgacagaacctcacctggggctcctcccatggcagtgccatgtggtccaaaattgccctttccttctccgttagtcacatttcccataactcctccgagccaacataacctacagtaagatgtgagtgtcagacgttctctccctggagtctgctttccaaaggaggcagggtgagtagatttcttgatccaaaggaatccgtttttaatttttttttttttctagagatgggggtctcactatgttgcccaggctggcctcgaactcctgagtttaagtgattctcccacctcagcctcctgagtagctgagaatccctttttagggtacaatttcaggcagtgtggcatggagtcagaagcaggctgtttctcctcaggggagggcaggcttctcaggacggcctcagctcatagccccacgtgtggtgtgcacggatgtgcagggagagcctgattgttaggtggatgtattttccagaatcggggagggactgaacacgagcatttcccattaatatgtgcaataaatgtcttggggaaggggctatttgaccctcattcccatagttttggcacttcaaatgaagctcttccttgtggtcaccatctctgctgtgggcacacagcttctttttcttgtttttttttttttttttttttttttgagacaccgtctcgctctgtcacccaggctggagtacaatggtgtgacctcaactcactgtgacttccgcctcctgggttcaagtgattctcctgcctcagcctcctgagtagctgggattacaggcgtgcaccaccacgcctggcgaattttgtgtttttagtagacatgaggtttcaccgtgttggccaggctggtctggaactcctgatctcaagtgatccgcccgcctcagcctctcaaagtgctgggattacaggcgtgagccactgcgcctgcttggcacgtggcttctgaatggcctgagtgagggcagggcccaggcatggaggctcctgcacccccaaggctttttggctgtgctttatggcctctggcttatactcaacccaattttacaagcatgaacttagacttctctttagtatttatatatttaaaaaccaagtttaaattaactcaaacttgacagcaactaacctctgaaagaaactttaaagaaaattgaaatcttgagccacaaacatgttctttcctcactagctcctcccaggttttatcctgcacccagcttggatgagagacccactgtttcttgtgcctacttaacattagggttccccgtggcagcttcatcctgagcactgcctgtgagccctggttctgggacttggcagtcgcctccctggagcatctttccagagccagcattagaacctgagatccccagatgtttctgcccctcatccccatcctgtgaatagagagacagaaaaggtgcaggttcccattctgcatagattctgctgtttcctctccaccggtcccaggcagcttttcctttccatcactgccgcttagcaaaaatgtgcttcttttgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtcaggtgaatggataagaggcagatcggcagaaagcatcagtgtggtcccgaggctccctctgttttccttgccatggagtccccagcgccttgtgcctgtttccatttccctctctctttgaaaagtagaaatcagtggtttcttgactcctaaacagcctcctcactatagaaggagcctgagcaggtcagaagaactagaaaagtcctcagatacccccctctgtccagccccctttcccatacacagatatcaatggatgagcaggaaaagaggaggcctggactcactgaagtacttgaagaagcacaagtgtcatagatgtgccgccctttgccctgggtgttctagatcacacagaacacgtttcagctggactaagaatcagactagccaggggttcttctgaacagctcaggccagacctctgggctcctctgggggccctgggacatgatgccttgcagtttccattccattgtccccaggcctcctgacctggtgacagagagtgccctgcagaagtgagtctatttttcccaattcctcttcatgaccagaaaatggcagctggccggttggggtcctgtgggaaagggctaacctgggctgttaggtagacactaggtttaaaggtagacagggagatggcatcatcagggcaggccaggcccacttcctgtgaccccagaccttggcaggcgggtcgtgctgaaaccaggcatctccctcacacctggggaaaggtttagggcaacatgttgcctcttcatcccattaaccctagaaatcttctggttagagtggccccttaccccaaatctggcctaggtctgaagactgcaggatagtcatgatgggcccatcctagagcctggctagctggaagacgcggtatggcagggacaggagggcggcaggaagggctttgtggccctgctggggccaaaggcagttttctgtgctccctttagccccagcctggctggccaggtctcctgtacttcaggggaccatggggccgcccaagccagtcaccttccccttccaagctctccccccatgactgttgatttctggcgcgtggaggcagagttgtgaatccacaaatgctgtagcccatatctcgtaatgtgtctgtgtccacttagagcctcacgacctggctgtgtgtgtgcatgtgtgtgtagtatagtttgtagttgacaatatgtgtatataatagctggtgtatttatatgtgagtgcagaattagtgcccgtggcggttttctgtattttaaacccattgaattggttagttttattttagggaagtgggaaaggcggagtggggggaagtataggaagaaggattcttagcaaaatcattctctaggactattagtcgcgatctcccagtgagccatcacgatgcccttttcaaataaatgttaatgttgtcaccaca

SEQ ID NO: 6311 - DNA, 3685 bp, Homo sapiens
  ENST00000402191
gtgcgcgcgcgtctgcgctgcgaggacaaagatgcctcgggccggggaccctggggtcctctccaggcccggcgcgtgccggtgctgggcggtggtccttcggggggcggaggctcaggggaaagcgggtctcccggagccgagcagaccgggagtgctggaggaggtggtcgtgtggcagcatttgcggaattaacaaaagcggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacct

SEQ ID NO: 6312 - DNA, 2432 bp, Homo sapiens
  ENST00000405108
gcaaataagctttactacaaccatatctgaaatgtgttttcctgatcaagtgggatgggaaagaacagtgagtggagtcccaggcatgttaagaatggcgtgctgttttttaagtgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgt

SEQ ID NO: 6313 - DNA, 1980 bp, Homo sapiens
  ENST00000264719
tttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcct

SEQ ID NO: 6314 - DNA, 4489 bp, Homo sapiens
  ENST00000509793
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgta

SEQ ID NO: 6315 - DNA, 4880 bp, Homo sapiens
  ENST00000265171
gaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaa

SEQ ID NO: 6316 - DNA, 3642 bp, Homo sapiens
  ENST00000503392
cagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatg

SEQ ID NO: 6317 - DNA, 683 bp, Homo sapiens
  ENST00000502723
gtgtgaatatctacaggaactctttattgtctataaatagactttattttaaacagaaaaccagtaattaaaaattatttctgcttgtgttggttgtcattgggaagtattttgtttaaatgagataaaatattaaaagtatacagtttggtctctttcttcccacccaggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggc

SEQ ID NO: 6318 - DNA, 584 bp, Homo sapiens
  ENST00000504633
gagaaaaaagtgggcttcgggatgctggggaatctgggctctggctaagtttgcctccgtgagagatgcagctgtagacgttgtagggaggtaagacctcttaagaatcaggaaaagatttagcagtgtcctctgtcaaaacacggccccactccaaataaagcatcttctcttttagagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagcca

SEQ ID NO: 6319 - DNA, 580 bp, Homo sapiens
  ENST00000502579
ggttacacgtatctgggaagcagcctagttcgaatttagttgcaggtgtgcctatctccaaagtcaagctcttaacaccctgtacaacctaaagactagtgccatttgtatatattccacattagttttaaaaaaaaatcagaaatgcctgtgttctcttttgtagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcag

SEQ ID NO: 6320 - DNA, 432 bp, Homo sapiens
  ENST00000541061
tatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggaagaagctaaccaactaataatctgtataagatacctattttgcccattctctttggcttaagataagtataatttaaaattttatgtatttataagattctctaaaaattaaagatatacttcacaataagtgatatgcttatgcacaaccttagactttatcatccttttacttcaggggtatttattgacacattacaggaactgaagatacagtggagggtaaaacaaatatgatatctgcaaagccaaggaatctagtgcagaacacatacattact

SEQ ID NO: 6321 - DNA, 567 bp, Homo sapiens
  ENST00000511228
atcttagaatcagtggctccttgggggaactcttctgaaatagctattgatataccctctatttagatacactgcatttctctccctaaaagctatagctccctaaaagcaagctgtagacttgcattaatggcatccttttcatcttcaaacccacttgtgaatttgtttcttttctctactaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatg

SEQ ID NO: 6322 - DNA, 1464 bp, Homo sapiens
  ENST00000509996
gaaatagctattgatataccctctatttagatacactgcatttctctccctaaaagctatagctccctaaaagcaagctgtagacttgcattaatggcatccttttcatcttcaaacccacttgtgaatttgtttcttttctctactaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattag

SEQ ID NO: 6323 - DNA, 773 bp, Homo sapiens
  ENST00000544918
cacacaaacacacacacaccctctacctcacagaaccttggaaagagtgaaacactgtctggaaagcattttgagttctgcagaaaagactgccttaaacatctaaagttatgttcctagttatcttcatatttcttctctcccacacaagtacttaaattttagtagcaaaagcagttagttgtccctgatcatcactgagtgggctgagtattttgttttgttgtgagattgtctcaaattttggctttatcacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacg

SEQ ID NO: 6324 - DNA, 491 bp, Homo sapiens
  ENST00000537316
acaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaac

SEQ ID NO: 6325 - DNA, 324 bp, Homo sapiens
  ENST00000540840
acaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccagaattttccctcttggtgtgattgcacagaatttgtatgtattttcagttacaagattgtaagtaaattgcctgatttgttttcattatagacaac

SEQ ID NO: 6326 - DNA, 452 bp, Homo sapiens
  ENST00000459688
ccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtgggg

SEQ ID NO: 6327 - DNA, 561 bp, Homo sapiens
  ENST00000463948
caggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggataatg

SEQ ID NO: 6328 - DNA, 691 bp, Homo sapiens
  ENST00000450046
atcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccag

SEQ ID NO: 6329 - DNA, 665 bp, Homo sapiens
  ENST00000485503
tatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttcc

SEQ ID NO: 6330 - DNA, 4735 bp, Homo sapiens
  ENST00000638463
atgagttctctgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 6331 - DNA, 5464 bp, Homo sapiens
  ENST00000454757
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 6332 - DNA, 3844 bp, Homo sapiens
  ENST00000455089
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 6333 - DNA, 2239 bp, Homo sapiens
  ENST00000342916
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 6334 - DNA, 2864 bp, Homo sapiens
  ENST00000344576
cccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 6335 - DNA, 1570 bp, Homo sapiens
  ENST00000420316
ccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaa

SEQ ID NO: 6336 - DNA, 9821 bp, Homo sapiens
  ENST00000275493
gccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 6337 - DNA, 2709 bp, Homo sapiens
  ENST00000250457
ccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcc

SEQ ID NO: 6338 - DNA, 1004 bp, Homo sapiens
  ENST00000553215
ggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttgggg

SEQ ID NO: 6339 - DNA, 864 bp, Homo sapiens
  ENST00000556785
caactacctgtaaatgtcacgtaacacccaaggagactgtgttacttatctgctcaccagtgggaggagaagattgtctgtctcagctttgttaaccagctttcttgggatttctccataggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaa

SEQ ID NO: 6340 - DNA, 848 bp, Homo sapiens
  ENST00000487915
acaccctcaaagatcagccaggggaaactacttctggtttctgcagctttcatctaggaagaggtgggctggatacacccactcgtttcccaccatctccagaaggagcagctttaactatgactcagtgatgcagggcttctgaccacaacctaaaaatgaaaggccctatcaccaatcttatctgctcatcaaaaaacagacggtggtgatatgcagtcaagcttgctggtacttccaatgcctgccctgagaaggttctgccatggagatgaagacacgctggagccacaggagtggttctggaacatctaaccttcttgtgcaaagtttctatcataacttgagattagacatgctcttattaggaaagttgcagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgttgttatgtccaaagccatcttgccatgcgcagcctgagaatggagccaatgactgagggtggcagagcagaaagatggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaa

SEQ ID NO: 6341 - DNA, 2849 bp, Homo sapiens
  ENST00000547327
ccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaaacgtgtgggagtgaaggggtggaggtggatgagtgcagtggggagtcacagtttgccgtacaacttccaagccaagaggccatgaatagaatatctgaaagcatcgttattaatgcacccaagtaaagtaaatcttagaagatactgctttctaaattttactttggggaaaaaaattccgcgtgagctgaactctgtaggagattgatgctaaagtgtttctttattcttcttccatcatgttggtggtggattagtcactcgtctttgactagtttgatttttgcattaaatgaccttgctgtcttctgtggtggaggtgtgtcggggaggggaagggtcagcctcagtgttgctgagatgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaaca

SEQ ID NO: 6342 - DNA, 566 bp, Homo sapiens
  ENST00000550114
aacgcgttggctctttctgccgtctgagactgtgtgatgtgctgaagccaagaagagataaatggtacgaggctgatatgggagcatccatcactgactaccaggttgctactcccagctcctgtcttcacatctgcataccaaccagtaagaagaggagaaggagcaaggagagcacataactttccttttaaggacacaactaggcaagatgccatgttgtgagctgctctgtggagggggacctgtggcgaggaactgagggcagccagcaggcaacagccagctgccatgttgtgagtagccctatggaggggcccacatggcaaggaactgacatctttggtcaacagtcagtgaggacttaaggctgccaatagccacatgagggagcttggaagcagatcttcccccagtggagccttgagatgactgcagtctggctgacaccttgattgttgccttctgggagaccttgaggtgggggacccagctaagctgcccagcttcctgaccggcagaaactgggagacaataaatgttggtgttttaagccactacatttt

SEQ ID NO: 6343 - DNA, 575 bp, Homo sapiens
  ENST00000551935
ttacacggatcacgacttgattaatgcttgtctcccagctaggccgccagctgcacaagcagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgttgttatgtccaaagccatcttgccatgcgcagcctgagaatggagccaatgactgagggtggcagagcagaaagatgagataaatggtacgaggctgatatgggagcatccatcactgactaccaggttgctactcccagctcctgtcttcacatctgcataccaaccagtaagaagaggagaaggagcaaggagagcacataactttccttttaaggacacaactagatgccatgttgtgagctgctctgtggagggggacctgtggcgaggaactgagggcagccagcaggcaacagccagctgccatgttgtgagtagccctatggaggggcccacatggcaaggaactgac

SEQ ID NO: 6344 - DNA, 535 bp, Homo sapiens
  ENST00000548285
ataatgacatgatagctaatccatacccctgcatgattttatcttccacggaaggaggctggcaagtttaaaggggacaccctcaaagatcagccaggggaaactacttctggtttctcagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgtatcaaccattttaaatctgccctcaaaagcacagaacaaatcagacagcattttgctcacagaggagagggtgtatgagaaccaaattccagcttcagcacatggccttgggtacagctacaagatggaggaagctatttgacctgcatcagactttacgtgaacaaaagggtgttgttatgtccaaagccatcttgccatgcgcagcctgagaatggagccaatgactgagggtggcagagcagaaagatggtaa

SEQ ID NO: 6345 - DNA, 581 bp, Homo sapiens
  ENST00000546681
tttgaagtacatgaattccctctgcatgtatactcccacctgaccattgaattaagcagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgtatcaaccattttaaatctgccctcaaaagcacagaacaaatcagacagcattttgctcacagaggagagggtgtatgagaaccaaattccagcttcagcacatggccttgggcaccaagacctgtactcgttggagactatgatggacaacacaacatgaatttcttgccctcaggtggtttacaatctagagagggaggcagacaaatgaccagatgacatccgagagaccaagctttgcctgccctcctgtggccttggctgggggatcctcctgtggcccatggaaggggcatttctctgaactgaaggactccacctctcctatgctataactggccagggatgggcctgcagtggctga

SEQ ID NO: 6346 - DNA, 352 bp, Homo sapiens
  ENST00000464521
tgtggtacagcaaaggccaaacagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgtatcaaccattttaaatctgccctcaaaagcacagaacaaatcagacagcattttgctcacagaggagagggtgtatgagaaccaaattccagcttcagcacatggccttgggtacagctacaagatggaggaagctatttgacctgcatcagactttacgtgaacaaaag

SEQ ID NO: 6347 - DNA, 658 bp, Homo sapiens
  ENST00000557521
agaagtcagcagatccaggctctgagccagctctgtcgggttactttctgtgttactgaatgtctctgctttcctcagttgaacaaagcaaagatctgtagcccaagaaaggccactgggcaattgtaatggctaggctagggcaacagaatgtgctgagggcagcgtggaaatggtggccaaggcactaaagaccagctttctctttcatgggagcctgaaatgaaccctctgccacctcccttccccacccatagattcctttcccatttacaggcagctaggttggccttggcctggactgggtttctgttttgtcaaactaacaggtttctgctgggaggagggcactggcggaagtagcataacttatctttggtttaggggtggaacttcggttgtttctccaggcacgtcatgtcttggcttggaccatcccttgctaaagcactgtgcttcacatccttttacgggaagtacacgaccttccatctccccgcaggtgtgggctggacccacaggacccaggcaaagccttttagggtgtatcaaccattttaaatctgccctcaaaagcacagaacaaatcagacagcattttgctcacagaggagagggtgtatgagaaccaaattccagcttcagcacatggccttgg

SEQ ID NO: 6348 - DNA, 3138 bp, Homo sapiens
  ENST00000239938
gcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 6349 - DNA, 4336 bp, Homo sapiens
  ENST00000317216
gatcaatactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgtt

SEQ ID NO: 6350 - DNA, 1553 bp, Homo sapiens
  ENST00000522910
ctcttcccgggaggagcccggcgtctttttcacccgcgctctccccccttactccctcagcctcccacccgggatggagccatgtgcggcgtggagtccccgcggtgggagagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaa

SEQ ID NO: 6351 - DNA, 1500 bp, Homo sapiens
  ENST00000519492
cacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagcctcccacccgggatggagccatgtgcggcgtggagtccccgcggtgggagagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctg

SEQ ID NO: 6352 - DNA, 1230 bp, Homo sapiens
  ENST00000524088
gatggatggatggatggatggatggatggatggatggatgggtggatgggtggatagataaatggatggagagatgggggcgcgctgggaattttgcggggggcgagttgcttttcccacccactcctcccgccctcctcgatcgagaaggctaggttggcgacgccacggtagaggcttcggttctcccgggtgggggcagccgccgaccggagggagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgag

SEQ ID NO: 6353 - DNA, 505 bp, Homo sapiens
  ENST00000518773
acccgcggggcgagggcctgccacggggaacgatcccggggccggggagctggggaagggcggcctctcccgccatggagacaccggccggttttccgccgctctccaccctccctagctggggctaggattttcccctccagcaagagcctaaagctccttcatgcccgaggaggctggggccgggagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccg

SEQ ID NO: 6354 - DNA, 4636 bp, Homo sapiens
  ENST00000322054
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggtacctgcctggccacagagcatcattcaatggaggctgagggagaagggctgggttcttacttggagttcctggtgaaatctttggctggaaagggctcactggggccacccaatggccagcatccacaaccagcttcccagtgggctggagtttgtctaggctcagtgaccaacccaggcacagctggtggagccaccgctccctgctcctctggagtgaagatgttccctaagcccctgggcttccttctgcaaatacacatttctctttcacatgaaatgaagggcagacaaaggccaggcaaagaggtctcacctgctctggagaaaacccttgagtgccgagtgcaggttagggaccatttctcaactccacacctttcttcaagctgaaggagaaatgggaaggaaatagcagaggtaggtgaagttcctgtctttttattttataggaaagggagatgtctgttatcccctttcttcactgccactggacacacatgccactttcctgcccttctacatatgctgcctctcttccctctctccatcttgaagtctccacccaggagagacctgtgaggtgtgggaattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaa

SEQ ID NO: 6355 - DNA, 4222 bp, Homo sapiens
  ENST00000419748
agttcagatgagaggtttagtgtaaagtggtataggacagaggggacagagttgagatatttgatgcaaaatctaggttcctggcaagtgaatgcattcttcctttcttggtacccttgtccagagattgagactgcgtggccagaagttgacaaaagaggtttaagggagcagggaagaaaaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaa

SEQ ID NO: 6356 - DNA, 4646 bp, Homo sapiens
  ENST00000303236
ggaaagtccaccttccccaacaaggccagcctgggaacatggagtggcagcggccgcagccaatgagagagcaaacgcgcggaaagtttgctcaatgggcgatgtccgagataggctgtcactcaggtggcagcggcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatt

SEQ ID NO: 6357 - DNA, 2902 bp, Homo sapiens
  ENST00000415570
aattacttttggttgatggactgcactgcttcatgtgctactcagaaggaggctggagtacatcaggatcaagactccagctcttaattactattattcttttaaaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttga

SEQ ID NO: 6358 - DNA, 582 bp, Homo sapiens
  ENST00000470706
caccatcagttaaaatacgcagaatggatcctttcgctacaaaagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccag

SEQ ID NO: 6359 - DNA, 666 bp, Homo sapiens
  ENST00000478003
ggaatatgatattttggtagatgataggaagtattggacagcacacatcactagtgcagcagttgtaagaaaaagtgattaacaagtgattcccaattaaacatgtcttttttatttttaatttttttctaggaaacataagaatgtgtttgcttcatttatacaaacaggactaaaaatgctgttaatcaaattcaaaatatactatttattaagatgagttctatgagtttatacatttttatgtgtcataagattgaactgattttcacattaccacaaaatttaaaactgttgcaaacctttataaattttatctctttttaaagatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatg

SEQ ID NO: 6360 - DNA, 534 bp, Homo sapiens
  ENST00000477083
tctgcattgtgttgaggaggccatgccatcctatctggccgttttttgagcaaagcacttcaatctctgtttacttcggtagtctcatctgtaaacaacaggattgaacccgatcacctggttttccgatttgatgtgctgctacataattctggtattgtagaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtacca

SEQ ID NO: 6361 - DNA, 2858 bp, Homo sapiens
  ENST00000253039
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 6362 - DNA, 367 bp, Homo sapiens
  ENST00000487075
gatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtaagaagccataatatgaaataaatctatgaatcactttgagaggcattta

SEQ ID NO: 6363 - DNA, 773 bp, Homo sapiens
  ENST00000423068
ggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaa

SEQ ID NO: 6364 - DNA, 453 bp, Homo sapiens
  ENST00000460032
aagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctact

SEQ ID NO: 6365 - DNA, 215 bp, Homo sapiens
  ENST00000457332
cggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggcgtgagccaccttgcccagcccacatcatacagtttgaaatgaaactttgccacaaccagcctt

SEQ ID NO: 6366 - DNA, 1734 bp, Homo sapiens
  ENST00000269349
acgcacgcacgtctctcgctttcgcatacttaaggcgtctgttctcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaactta

SEQ ID NO: 6367 - DNA, 3593 bp, Homo sapiens
  ENST00000575978
attgtgggtgactcaggccagcctctattgctttttatttggtatctaggactctcggggtgggtttcttgatccctagatcacttcagattgaagaagcaccaaagggaaaccagattccctcaaccagataacactccggtgggcggggagtagggacggagagaacgcgtggatgtggcctggtgctgtaaaaatgagatttcctgtcaaacgtaccttatcaccactctgcctctaacccagtgggaacactgggcgtgcaccttccatttctgggtgtgccgccctaaacatccctcacctgtcttgctccctgtcccaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacggtaggagcccctcttgtcaagtttactaaaacactgggccgcatttataaaggattttatgtcgtaatttcaaaaactttttatagccagagtctggctgtgttgctgaagctcgtgtcaaaacccggacctcaggctatcctcttgcctgagtgtaaaggaattgaaagcatgcaaattcttttaaaattcctgttttaaaaaaccaaataggctgggcaacatatagagaccgtatctctaccaataataaaaaattagccaggtagggcggcacatgcctatagtcccagctactcaggaggctgtggtgggaggatcgcttgaggtcaggaggctgaggctgcagtgagctttgattgtgccactgtacttcagccagggcaacagagcaagaccctgtctcaaacaaaacaaaacaacccatcttttataatcctcattgtggtttgaaccaataattctaaatttaaaaattaggtgactatttatttatcagtgtttcgtttagaatcgtattccatgtggtgcacattgtgaaatgttaagtaggatacagaatggaggcctgtgtgacggaagtggtgataggatggaggacagggctggggctgctgggtctgcaccagatatcacggtgtgaccttttccaccagggtctccctggatcctggcttggcccaccctcaagtcctagaaggaaggatgagtatgtaacaggatttgtctttgtccttcagtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccaggtgggtctgctatgctgtggctctgcaggtcagggtttgctagactgtgtctaagcacttcatatgtaccgcctaagtgcaggccccacacccggggggatgccaagcttctgctctgaaagctgaggccctgggtgagcagaaaaccttccagttaaggaggggtccgctgtgctcctgtaatacttaggttgaggtgataactagccttaactagccaggttggtcaccttggttacaagcgtgtgtcttcttttccagtaagtaggggggttttctgttcatcgtttcgattagtttaattccacagtggtcagaaagcgtggattgggtggtttcattcatttgaacttgattcagacttccttctttgcccaccttgtggtcagcttaacatatgtgctgtgtgtgtctttttttgtttgtttgtttttgagacagtctcacttcgttacccaggccggagtgcagtggcacaatcttggctcactgcaacctctgcctcctgatttcaagtgactcctgtgtctcagcctcccgagtagctggaatggctaatttttttttttttttttcatttttagtagagatggggtttcaccatgttggccaggctggtctcgaactcctgacctcaggtgatccatctgcctcagcctctggcagtgctgggattacaggcataagccgccgccatgcccggctgaagttaccgtttttaattttttgctaggcaaaagtgaagtatttttcccaattattggtttaggaccgattaaacaagttaaagatagtctagtaaaagatgtctatttttttaatctgatggagcacatgaccgaagtaactaaatccaccaacagcccctctgcacaggggtttctggtgctgtccctgaggcttcacgtttgcagacagactgttgagagaggagaatctcgtatattttggacctgcagccaggattccttaaaattagcaatggaagcaagtccagtcttacacttgtatgagtaatttaatcgcctcaaacactctttctttttgcagccgagtgcttatttctacagatgtctgggccagggggttggatgtccctcaggtgtccctcatcattaactatgatctccctaataacagagaattgtacatacacaggtaaggtgcaagctctcattggcttcacttctgtgacacatttactaaatcttgattgttatatatactaactgtaatattattttattcctgaagaattgggagatcaggtcgatacggccggaagggtgtggccattaactttgtaaagaatgacgacatccgcatcctcagagatatcgagcagtactattccactcagattgatgagatgccgatgaacggtaggaaatcgtccagctctactgtaattgtagagggaacttccctattcttagtttggggcacctgagtttgtttttttgttgttgtgggtttttttgttttgtttttgagacgaagtttcgctctgtcacccaggctggagtgcagtggcgcgatttcggctcactgcaacctctgcctcctgggttcaagcaattctcctgcctcagcctcctgagtagctggaattacagacacgtgcaccatagccagctaatttttgtatttttagtagagacggggtttcaccatgttggccaggctggtctcgaactcctggcctcaaatgatctgcccacctcagcctcccaaagtgctgggattacaggcgtgagccactatgtctggcctgttttttgttttgagaagtctgttgtgaggttttagttaaatttacgttaacaaattttcattttgtttgtgttgttccttaatctgtttctttcttcactttcagttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaa

SEQ ID NO: 6368 - DNA, 562 bp, Homo sapiens
  ENST00000570625
tctacagatgtctgggccagggggttggatgtccctcaggtgtccctcatcattaactatgatctccctaataacagagaattgtacatacacaggtaaggtgcaagctctcattggcttcacttctgtgacacatttactaaatcttgattgttatatatactaactgtaatattattttattcctgaagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttt

SEQ ID NO: 6369 - DNA, 697 bp, Homo sapiens
  ENST00000576573
gaatattgatactggttctgcaaatgatgcggtaaagtcccgaatgcacatctctgctttggtatactagcttgcagtagcatctgttgattggatttgtaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttt

SEQ ID NO: 6370 - DNA, 831 bp, Homo sapiens
  ENST00000575668
ttgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccaggtgggtctgctatgctgtggctctgcaggtcagggtttgctagactgtgtctaagcacttcatatgtaccgcctaagtgcaggccccacacccggggggatgccaagcttctgctctgaaagctgaggccctgggtgagcagaaaaccttccagttaaggaggggtccgctgtgctcctgtaatacttaggttgaggtgataactagccttaactagccaggttggtcaccttggttacaagcgtgtgtcttcttttccagtaagtaggggggttttctgttcatcgtttcgattagtttaattccacagtggtcagaaagcgtggattgggtggtttcattcatttgaacttgattcagacttccttctttgcccaccttgtggtcagcttaacatatgtgctgtgtgtgtctttttttgtttgtttgtttttgagacagtctcacttcgttacccaggccggagtgcagtggcacaatcttggctcactgcaacctctgcctcctgatttcaagtgactcctgtgtctcagcctcccgagtagctggaatggctaatttttttttttttttttcattttta

SEQ ID NO: 6371 - DNA, 534 bp, Homo sapiens
  ENST00000570837
cctggtgtggtggcgggcgcctgtagtcccagctactcaggaagctgaggcgggagaatggcgtgaaccctggaggcggagcttgcagtgagctaagattgcgctgctgccccccagcatgggccacagagtgagactccgtctcaaaaaaaaaaaaaaaaaagcaaaattaacttgtttttgtcagagaaaagagcaggagaattttgtggtttcgagataataatggcataaataataatcggtgatcatctcggaggagaaacagtctttctttttggaaaacgtggatgtttctctctcccaccctggacgtgaacctgtgctttgtttcaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgat

SEQ ID NO: 6372 - DNA, 553 bp, Homo sapiens
  ENST00000576547
tcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggggctgcttgctctcggtgactacatgaatgtccagtgccatgcctgcattggaggcaccaatgtt

SEQ ID NO: 6373 - DNA, 574 bp, Homo sapiens
  ENST00000575957
tcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggtaatttgccattcttaaaacaaactgttatgtaattctaggaaatacttgctttttcttctgtaactacagtgttcaaaaagtaca

SEQ ID NO: 6374 - DNA, 3691 bp, Homo sapiens
  ENST00000380110
gcccgggtgcggccgcgtgtagcgcaagaaggaaactgttgagacgcagacggcaactccaaactaacatggcagtcagactgtgtgatgtggcttctctgcttagaagtggttcgtgggcagcagagccttggaccgggcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagagcaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaa

SEQ ID NO: 6375 - DNA, 3763 bp, Homo sapiens
  ENST00000223951
agtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaa

SEQ ID NO: 6376 - DNA, 2370 bp, Homo sapiens
  ENST00000380117
gagcctggcagagcagctgcacacacggcagtgcggaggcagagaaggggttggtgatacggtgctataaatctgtggtccagtccacctcccttttaagacgtcctcccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcata

SEQ ID NO: 6377 - DNA, 777 bp, Homo sapiens
  ENST00000423281
ggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggta

SEQ ID NO: 6378 - DNA, 723 bp, Homo sapiens
  ENST00000440102
gctttcttcccttgcctttgaagactttctgcaggccctggaattgcctttgttcctctgtctgcccactttgccagtgtgaagcaggttttcatgggattctactggggtaaaccaaaagcagcagaaaaagtgtgaacaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaa

SEQ ID NO: 6379 - DNA, 424 bp, Homo sapiens
  ENST00000462649
ctaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagacggcaactccaaactaacatggcagtcagactgtgtgatgtggcttctctgctt

SEQ ID NO: 6380 - DNA, 3805 bp, Homo sapiens
  ENST00000397312
caataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 6381 - DNA, 3789 bp, Homo sapiens
  ENST00000544538
acaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 6382 - DNA, 4729 bp, Homo sapiens
  ENST00000359227
cgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatcttaa

SEQ ID NO: 6383 - DNA, 1223 bp, Homo sapiens
  ENST00000438662
ccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagg

SEQ ID NO: 6384 - DNA, 367 bp, Homo sapiens
  ENST00000588853
accccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagacaaagccatcaacaccctcaacggcctcaaattacagacgaagaccat

SEQ ID NO: 6385 - DNA, 466 bp, Homo sapiens
  ENST00000592218
agagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactgcccagaccccgcaggccg

SEQ ID NO: 6386 - DNA, 3775 bp, Homo sapiens
  ENST00000371827
gtctgacttggagttttgtgctgttgcacgtgaatgctctggaactgccctaatcgactgaaaatgagccggctacagtcatatggaacagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatg

SEQ ID NO: 6387 - DNA, 489 bp, Homo sapiens
  ENST00000463650
tcttgcaaagagagcagtacatataacaggagtctactgtgtgtgagataaggggaaaattcagctcactgactagaggttttaatgtacgaactctagggaaataatatattgactgttccgtggtgcgcaagaaaattgaagaaccctttgcagacggagtgctttgcaaaggattctatctgtttctcttaaaacaaaatctgtggcaagatgtttgaaatcagcaggacgcttaatgctgctttgttaaataatgagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgaga

SEQ ID NO: 6388 - DNA, 1442 bp, Homo sapiens
  ENST00000357083
tgccggcgactgatgctgagatatctgcaacctttgggatgtgtgcatggtggcaaggggctgactgatatgagattacttcttttaagggaaattgtcattaatgagtcaagaaactgctcatttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaa

SEQ ID NO: 6389 - DNA, 3966 bp, Homo sapiens
  ENST00000371824
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttgacttcccaaa

SEQ ID NO: 6390 - DNA, 1591 bp, Homo sapiens
  ENST00000371823
tagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaa

SEQ ID NO: 6391 - DNA, 3349 bp, Homo sapiens
  ENST00000371821
taaacctcgagaggcagctcctggatactgaacactgagatgggcagttgtgtttcgggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaa

SEQ ID NO: 6392 - DNA, 2467 bp, Homo sapiens
  ENST00000371819
aaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaa

SEQ ID NO: 6393 - DNA, 458 bp, Homo sapiens
  ENST00000494555
tggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgccttctagaatcctaaagttgacctgaagccaagaagaaaattctggtgatgggagaagtggagccacttaaattacttacatgatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaactt

SEQ ID NO: 6394 - DNA, 2106 bp, Homo sapiens
  ENST00000492299
ttagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggccactgtttacctctgcttcagtttgctttgataagtgacatgagatctatctctttgctctgactcccatgaaggaatagttaacttgcctatctggaaaaaaaccaagtatcttctttggaagcgtacattacagaggtctcaggaccatctagtacatgtttgtgaactttggtcaaatttccccctccttttcaaatttctggagtgcaaaacactctactttaaatgttatgcacaaagtaggttcaggcaaatcaatagttaattccaaagctgtgaaggttaatgattaacagctggattcagggaaggttctggaaagctctaaggcatcggtggagactgtagtgagctgtaaagaagacagctattctgctgctgctgctaactgtttaaacccagattgttgccagatctaccagttgtccaatacacatgaaaatctagatttttttcctgccaatctcccaatttttaaaagctagaaaataactcaaagaattttaagaattatgtaggtgggccaaacagaacttaatagttgaccttttgacaggcagtttgcaaaccaccccccaacccacccccaccaaaaaaaaaatgaactcaaatttaaatatgaaaacatcgttttgccaattggtagtgaatggctcattacaggtccactacaggctgagcatcccaaattggaaaatctgaaacccaaaatgctccaaaatttgaaactttttgagcacctacatgacactcaaaggaaatgctcattggtgcattttagatttcaagtttttggattaaggatgttgaatcagtataatgcaaatattccaaaatctaaaatttgtggtcccatttctgataagggatactcaacctgtactaggaggtacccacaaatgatggttcccagtcaacaaatatccatttcccttttattaggggcagtgttacatgactctgtgtgaatactgacagcattcagagagcaatctgacctctgttctccagaagcatgcaatctaggcatcggcacagcaccaaagcagagaaagagcatgatgtgtaattaagcttccaatgcatagtgtggatggtgactccaggggaattgttctttgggttataacttctttagtgggagaaagttcccaccacacatcttggagatcaggctcagagacactaagtgacttgtccaaagccatacaacaggccagcagtggagctcaagttagcttcaaaagggcctctgaaggattctgccagaagaggagctgcttaatatgttagcatgagcttgaaataataataataaagattaatagtaatgctaatttatagtgagtattcactctgtatccaatactattataacccttttacatgcttaatatcatttcatctttgaaatatccctggagctaggtgctttacacacatcaactctaattcttaaaatagccctgtcaggaggtactattacctcctttatacaggtgaggaaactgaggcccaaggaggcttagagacacacccaggatgacacaattgataagcaagacttggagtaagaaaaaatgttctaaaaataactctctggcagtaggtcgtaagtgttggaatgtcacactgcctgcttgctcagcaacacgtgcattctgtgagggtgtgtgggtgtgtatttggctctgtgcacacatgggttatactctctggcatgggaaggagaataaaaagcaaacaaatgaa

SEQ ID NO: 6395 - DNA, 600 bp, Homo sapiens
  ENST00000474675
aaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggtaattaaaactccacagattgccagatgtccatgttggcacagactggggctagaattttttttttttaattcactaactttactttaaaagaaaaaaattcttcctttttcttcca

SEQ ID NO: 6396 - DNA, 1951 bp, Homo sapiens
  ENST00000448907
aggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgcc

SEQ ID NO: 6397 - DNA, 3005 bp, Homo sapiens
  ENST00000379549
gccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 6398 - DNA, 3278 bp, Homo sapiens
  ENST00000379550
gattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 6399 - DNA, 2219 bp, Homo sapiens
  ENST00000514606
ggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggtaatttggggagggttgctttggaagtgagatgattttttttcagttaggtgacatttttgtatttgtaagaaaactatttctagtacatgcacatatgagaatactgtcgctggtaatagttcttaataagggatgtatcagcatcacgtggggagctttttcaaaatatctgtgcccagttcctacaccacagagattctgtaaccatagttgtatcatgggggatatagggacttggaaaaagtccaaaggatgtctgatacatatcctccttaagaaccattgacttacaggataatagcacccatcctcatatatagctacccataattcaaaggggtttacaactaaaccttgtttctaataatttctttcttttcttatttttgtgagacagtgtcttgctctgttgcccaggctggtgtgtggtggtgtgatcatggcacattgcagccttgacctcctggtcttaagtaatctttccgcctcagccttctgagttgctgggaccacaggcacatgccaccatgcctggctaatttctttctttctttttttttttttaattttttgtatagatgaggtctcactgtcattcaggcaggtcttaaactcctaggctcaagtgatccttctgcctcagcctctgaaagtgctgggactataggcatgagccactgcaactagcctgatacataacttcttaactgtttagaagaattcaaggtgagctaaatttaattttccaatcaataaatgtcagtcacatcagtcacaattcagaacaaaaccatgtttttgcttatttattgacttatttttacagacagggctagaatgcagtggcatgaccatacctcactgcagccttgcgctactgtgcttgtagcctcccaagtagctgggactacacgcacacaccaccgcacccagctaatttgttttttttttttttaagagatgggggtcttgtgctttgttgcccaggcggatctcgaattcctagcttcaagagatcctccggcctcacactcccagagtgctgagattataagcgtgagccactgccccttgcctatttttgctttagaatttgtgtatcctgattaaaaatgaaaacagcaccaaacctcccccattctgtgctttcctaatttgtggagtaagatgatttcaagtaacatttctttttaaaattatttttattatcttttttttttaattttaaaatcttttgtagaaacagagtgcccctgttttgcccaggcttgtcccaaacccctcgcctcaagcgatcctcccatcttggcctcccaaagtgttgggattatagacatgagccaccgtacctggcctttaattttcttgtcactcagattctgacagataaagtatcatttcagtagtggttttagatgtgttctgtctgcccatctgataaccgaaaatttatcactttcatgaataagtgttttcagaccaatattcaatagttggataaattttacattaatatatttaaatttattctgtccttatcaggtggtttgatttaataattttaaataattaaaacagaaattaagtctagtttaaaaaaaattgtctccagtaagcctaccaagaaatttggtatttcattaggtcaaaaaaaaaaaaaaaaaaaaaaaa

SEQ ID NO: 6400 - DNA, 563 bp, Homo sapiens
  ENST00000504314
ttattttccttatgtagtttaaatcatatcgaatattcagcaaattaacttcttcagtattaagctcttatcctgctttgattaattcttaacacacctcgcctcttctaaatattgaactgtccacataagaaacattgatgggggtgggaaattttaatttttcaacttttttttatagtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggc

SEQ ID NO: 6401 - DNA, 682 bp, Homo sapiens
  ENST00000514577
atagatatcaatggcttagagttagtcatgttattttatatttatttatttttcatttctctttcaggagtgaatatgtttatttcttagtaatatgttttagtcatgtgtttagtgtatttttaattgagtagaacttatttttcctccagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttg

SEQ ID NO: 6402 - DNA, 611 bp, Homo sapiens
  ENST00000512627
aatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccga

SEQ ID NO: 6403 - DNA, 510 bp, Homo sapiens
  ENST00000515489
atagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggtggcagtcacagaccagacaagaaagctgaagcgtcatccagacaagactgaaccataccttcagccaggacagactcatatggaaaagctctctaaagagaagggaatcccctccatgataaatgcttagtttaacatgttcgactggtgctcaattgtctattggctgacaaatcatttccacaagctgggcttttctagcacaatcctctgaaataaaaatgtgaaaaagcaaa

SEQ ID NO: 6404 - DNA, 1434 bp, Homo sapiens
  ENST00000511006
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggttaggcattcaatgaattacatttctattttcttcatagaaatttgtgcatgaactaattttgaaattaataggaaacatatttgagagtaaaaatgtacaaagcatgaaattatacatgtacatgtcgtgtatccttatataatttaggtaatagaaggtcaaggaaggtattgcagggcttacgtgaattgttggaacatacatatattagaatgaacttggagggaggaaaggaatggaaagaacactatagtattagttgagagttaaatttaaatccctcataaaacccattgtcttggattatactgtaggtatatactatgcccaaatacctaaattagattcattctaagttagaattttgtatgtgctttacttattatctttgtttcttgattattttatatctaaatcggtgtggagatccattgtattttaatctcatttaaacacgaatttagataattagtaagtcagaaaatgaattcagattttgaaattttatgcgtgtaggattttgaatcattagcatatttggttattttgttattgataacattgaagaattagatgagaataaaaaaataacagtagtagaaataccggggcttctaggtcctggcttctgttcttagcattcagtaaagagtgaatattggggccagtcgcggtggctcacgcctgtaatcccagcactttgggaggcccaggtgggcggatcaccaggtcaggcatttgagaccatcctggctaacatggcgaaaccctgcctctactaaaaatacaaaaaaattagccaggcgtggtggcgggcgcctgtagtcccagctactcgggaggctgaggcaggaga

SEQ ID NO: 6405 - DNA, 1766 bp, Homo sapiens
  ENST00000511184
tctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtggaatctcactctgtcacccaggctggagtgcggtggtgtgatctcggctcactgcaacctccgcctcccgggttcaagtgattctcctgcctcagcctcccaagtggctgggactacagaaatcctccctgtggcacaaaaggactcctttaattagaaaatattgttgccacagggaggtagaagatcgacatgaaaaactggggatctgaaaacgagcccctatcctaggattacctgaaggtgaaacagattgagccagaaggaagacaatgctgagaccgggtttcactgtgttagccaggatggtctcgatgtcttgacctcgtgatccacccacctcggcctcccaaagtgctgggatgacaggcgtgagccactgcgcccggccctgatacttcttatatatggtgtttgacaagtctttcaggaaaatctgaatttttttccccatatgaccttttttctgatgtgtaatagttggaaaataaaggcaggatttagaataattactgagaatgaaaaacttcttttgaagaggaaaccaagaacttggttcaagaggagaaagaaattaaaaggtggtaatttctttttgagacatttactttcttgaataaacttgacatcccccccttttttttttttatctttttctttagggacattggtctatagttagtatctaggtttacaacattaagcttttttcattttgtttggaaaaacaaggctggcagaattacatttgtttttaattccattgctaatattacatacttaggaggctatcaggtgcaagttatttacttgagacaagaagcactgattattttggctaggcttcatctgaaggcctatgttctgggaagggaggcctccataaaaaaggaagaacctttagtgacctttatccttgggaataaaagtaaagatcagaagccagtgcattcagtttaccgtcttacaaaaggagtcaagtattgtataggtcagagaccactattgtaagatcatataaatcctgtgtctaattttgtt

SEQ ID NO: 6406 - DNA, 882 bp, Homo sapiens
  ENST00000420916
gatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagca

SEQ ID NO: 6407 - DNA, 1965 bp, Homo sapiens
  ENST00000510408
ggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaag

SEQ ID NO: 6408 - DNA, 3036 bp, Homo sapiens
  ENST00000358635
cgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctg

SEQ ID NO: 6409 - DNA, 4012 bp, Homo sapiens
  ENST00000394235
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttggcaaatatctgcatgttgccagtttctttctaattatgatgaactataatgttctgcttaacgtaatgaatttagtattttagttggctgcacttaaagaatttatatttgtaaaacactttaaaccatttgtttcacaatcagaccttttgtggattaaaaagaacaattactcttctagcccttttacagattaggaagttaaggtatctgaaggattacataaactatgtaattttactactgtctgtcactccatatcttaatgctctttctactacaaagaaaagttatctatttttacatgttttagaaatgtagatgaactcatacataatattttttgtcttttaattgatcacatactacttaggtcagaaattgtttataacagttccctttgtaatcttttaaacttttccataaatatattgatgatacttttatacaaaagctcaaagaaaaactcacttgattattttcccatttgggagttac

SEQ ID NO: 6410 - DNA, 3845 bp, Homo sapiens
  ENST00000424383
tacgttggtctcccaaagtgctgggattacaggtgcagctgccttggcgaccatttgtcctacagtttgtccggacccaggctgtccttctgtgtgctggaatgaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 6411 - DNA, 3742 bp, Homo sapiens
  ENST00000561626
gaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcctgggccagggccgccgcggccaccgcagcatcctcagcaaactgcagtcagtctgcaccgaggactcgtacgcggctgaggtggtcgggcccccacgtccagcatccgggcgctcacagccgggccgctccccgccgcccccgcctccgccggagcccagtgacatgccctgtgccgatgatgagtgcttctccggggacggcaccacgccactggtggccctgcccacgctggccacgcaggccgaggcccgccccctcatcaaggtcaagcagctcactcagaactcggccaccatcaccgtccagctgcccagcccgttccaccggatgtacaccctggagcatttcaacaacagcaaggcctccaccgtgtccaggctgaccaaggcccaggaggagatccgtctgaccaacctgttcacgctcaccaactacacctactgcgtggtgtccaccagcgccgggctgcgccacaaccacacctgcctcaccatctgcttgccccggctgcccagcccgcctggtccggtgcccagcccctccacggccacccactacatcatgaccatcctgggctgcctcttcggcatggtgctggtgctgggcgccgtctactactgcctgcgcaggcggcggcgccaggaggagaagcacaagaaggccgcctcggcagccgcagctggcagcctcaagaagaccatcatcgagctcaagtacgggccagagctggaggcgcccggcctggccccgctgtcccagggcccgctgctgggccccgaggccgtgacgcgcatcccttacctgcctgcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgccgaggccaagtacatcgagaagggctcccccgcggccgacgccatcctcactgtgacacccgcggccgccgtgctgcgggccgaggccgagaagggtcgccagtacggcgagcaccggcactcgtaccccggctcccacccggccgagccacctgcgccccccgggccaccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacacacacacacacacacacacgagggacttcggaaaactgtgtcttagggatggggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaaaaaaaaaaaaaaaagactatgtctacttaaaaaaaaatctgcaaaggaaaacaaatcaaatgcttgtt

SEQ ID NO: 6412 - DNA, 2524 bp, Homo sapiens
  ENST00000396045
tgatgaatatgaactatctccagcccatcaccagctttttctttttcttcttgtccttatttgttttttagttctttataagaaaaagtgggggatatattgagaagtaccaagacggggagctatgggtttattgacaaaagagcataggacactaaaatagaaacgaagttattatttttctcttgtgatactctaagagaaaagctcttcctggaaaagccgatgatctctgaagatgctaaataaatgagcaggagtttccctgaaatggaggcgccctttgattggctgatctttccccgactcctgccaatcggagcatccctgggctccagctccataaacataagcaaagctacatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 6413 - DNA, 4022 bp, Homo sapiens
  ENST00000310758
aattagtgcctccaaacgccgtgtgtgagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 6414 - DNA, 1982 bp, Homo sapiens
  ENST00000396040
tggaggggcagcgtggggaacgagaaactctttgcctgtagggacccttctagctgcaaacttaaaaatgtatgtggcaagatgcaacccaagcaccgagcaggattccagacgagttataatcattctgaacggggagaggaaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaa

SEQ ID NO: 6415 - DNA, 3154 bp, Homo sapiens
  ENST00000442504
ataaacgcaggtcacctgagccagtagcagcaacctgggtccccttccacgctgtggaatctttgtttttttttcactgctcgcaataaatcttgctgctgcttattatttgggtccgtgttacctttatgagctgtagcactcaccgcgaaggtttgcagcttcgctattcactcttgaagccagcgagaccacgaacccaccgggaggaagaaacaactccggacgcgccacctttaagagctgtaacactaacggtgaaagtctgcggtatcactcctgaagtcagggagaccacgaaccccccagaagaaactccggacgcatctgaacatctgaaggaacaaactctggacacaccatctttaagaactgaaacaccgcgacagttcgctgcttcattcttaaaggcagtgagaccgagaacgcaccaattctggacacaaaaggaccttagcaggctcaggaaatggcaagccatttatgaagagggaagagatagcaaacgttggtctcaagttctctagttctttacccagaccatagctggctgggggatgatcctgatttagtctggggggttcctttacgcattgccaccagcaggtgccgcaaatggaccattggcagtcttaaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaag

SEQ ID NO: 6416 - DNA, 877 bp, Homo sapiens
  ENST00000497024
tttactgggtttttgtttgtttgtttgtttgtttgtttttgtggcctctctggaagggagatgctgaagaaaggagaataacacagttttggtggcgggcgaggaggcaggcggtgctgtcaccttggacactcattgagcctctctaagccccacctcataaaggagatgaaaacacttgctacatgggctgcatgcgaattaaatgagatagttcacagaccgccgtgaatggagagaaggaatcatgccgtgaaccttgaagagcatggttcctccttccatcagcctcattgcagctccgcttggctagacaagctggccctatgccatggtcaatgtgcagccatttgcaactgcaaaatgaaatgtgccgattttccttaaggtgctgttttctctcatctcttgtaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgc

SEQ ID NO: 6417 - DNA, 568 bp, Homo sapiens
  ENST00000487843
acatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacagg

SEQ ID NO: 6418 - DNA, 2621 bp, Homo sapiens
  ENST00000448602
gagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactga

SEQ ID NO: 6419 - DNA, 549 bp, Homo sapiens
  ENST00000464262
catttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaag

SEQ ID NO: 6420 - DNA, 881 bp, Homo sapiens
  ENST00000420636
gcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcatcacttatctcctgaaaaattcacactgccgtgaacacgatccagccttgcagtgtgtctcggagctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgatttt

SEQ ID NO: 6421 - DNA, 570 bp, Homo sapiens
  ENST00000472359
attctgaagacgagagaaagaggagcaggaagaatcttccatgaactctgcaaacctacaaactttccaatgagaagtggtgcacactcccgagatggtgcttgggacaacatggttaaaaggaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctac

SEQ ID NO: 6422 - DNA, 580 bp, Homo sapiens
  ENST00000433246
atcaagaaatccaaacctatactattgcagtgattaatgcgcttttcctgaaggctcctgatgagaggaggcaggttgatgtagagagcaatgttgacatccttgattgtcctctgactgagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttgg

SEQ ID NO: 6423 - DNA, 655 bp, Homo sapiens
  ENST00000487336
caggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccgggtaagcaagaagccccttttcagatattgtgtgtttcctactcaatgttaatttcaaactcacaaatacggagggattacctttagatgagtgaccccatattttctgtctttcttagtaaact

SEQ ID NO: 6424 - DNA, 610 bp, Homo sapiens
  ENST00000424212
caggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattgtaagtaagctatctccagtatgcgctctccctccagcctccccgggcctgacctcagccacataactgatgtctcttccgagcgtgtggtcctcttgcgctttacggaatagtttccacatttccagatgtttagctggtttaaacaggatcacatgaaaatctcttctggcttcagtgaaatggaataacttgcacaagtgtgactaatactgcatttgtttattcagttctgattaagtgtaaccgagagtagttagcccggaatgtatctcgacttcattaaatctatttcacaaga

SEQ ID NO: 6425 - DNA, 576 bp, Homo sapiens
  ENST00000455119
gtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgactttggagacatgctgtccttcaccctgacggccttcgttgagctgatggaccatggcatagtgtcctgggatacattttcggtggcgtt

SEQ ID NO: 6426 - DNA, 650 bp, Homo sapiens
  ENST00000455879
gaccatgacttcctgggcaatctgtccttcctcagactgttgagtgccagacgtttatatgcatgtctggacagagagtgagcctggctcattcagaccctgggcaccattcagagcagaactcagtggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttg

SEQ ID NO: 6427 - DNA, 2876 bp, Homo sapiens
  ENST00000463390
agtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagtaagttgatcttagcttctgacttccagcaaactctttgctctgcgtttctgctatatgtgattgtgggatattaatttttgaggttgactttagtgcaaagcaaaaggcttccagaatgtcctgacatgcagattctggattagcaggaatgcccctccgtagatttcccactgcagaggaggaagaccttattccaggcgaagggcaagcttgtctaacctgcggcccaggatagctttgaattcacaaattcgtaaactttctcaaaacattatgagttgttctgtattttatttagttcatcagctatcgttagcgtattttatgtgtggcccaagacattcttcttcttcctgtggcccagggaagccaaaagattggacacttctgctttaagatttgagtttggaggtcatcttaacaacttctgtgttacagctgggatcactcacctgtaccaattggttttacccacctactcacacatccacctaatgccatctgagcaaattcagacaacaaacaaagcaaacaaaaccaaagtcagttactttcctttaaagtcggttactttcctttaaagtcagtgtggctgggcgcggtggctcatgcctgtaatcccagcactttgggaggccgaggcaggtggatcaggaggtcaggagatcaagaccatcttggctaacacagtgaaaccctgtctctactaaaaatacaaaaaattagccgggcgtggtggtggacgcctgtagtcccagctactcgggaggctaaggcaggagaatggcgtgaaacctaataggtggagcttgcagtgagcagaggtagtgccactgcactccagcctgggtgagagagtgagactccatctcaaaaaaaaaaagaaaaaaaagaaaaagtcagtgtgtgtgtgtgtgtgtgtgtctgtgtgtgtgtgtgtgtgtgtgagagagagagagagtttaagtattttgtagctttaatgggttattatgacaattcataaaaataatttagaaatattgaccacttcactgatccattgacagctgattctacataagaactttagagtcttctgaattaaagctgctaaacaagacgctacagtatatttagactattgtagctgatgatgtctctcttcttggtctttcctacttgcttggagatactttaggtagtaacattagcatatttaactatattattttacagtgcatttcattgctttcctaaaaaattatctgccccaaatacaccaagtgttactattttcactctgcatatgtgatgaaaactgtgtctaactatcattttcagtttccactgaagccatgtggtagactaaaaataaatttaaaaattgggaaaagcatctggctaaaattaagctgtgggtactgtaactaccataaatccttattgttgaaaattacattagtgtggcttagaaactcctaaacattttgcccaataacatcctgaacctaaaaacagtgatgagctcaatggagtgagttgctacagttggctgaactgtctttgatgcctgctttgctacttaatggagattataatctactcatttttcagtggctacatgatgagctgaggcgttttcgtctgactttgcattggtcttcttactcaagtcagcatgaatgaatgttaatttgacctttacaccattgttttatgtgttttttgtagtttctgattatcctgctaaaagtcatcatctgcttgctggacagaaaaagtagaccttgccttttatttcattttagagtctaaaagacagctttttaatcaaagccttctctaagccaaagaaggagttagtttcatttttttactgctgtggatttatgaacaaaaattccgcaatctaagtcactccttgagagaaggcttagatgttaggcagagtgaagtttttcagcatcccaaaagaaacttagcgtgacttgtcatcaggaagaatggaatttgtgttcttgagataatgatcctcacattcccagctcagtgaatggaaagatgtgaaagccagtgtaagaggcactattaaaagatgggagcagccgggtgcagtggctcacgcctgtaatcccagcactttgggaggccgaggcaggcggatcaccaggtcaggagatcaagaccatcctggctaacacggtgtaaaccccgtctctactaaaaatacaaaaaaaattagccaggcgtggtggcaggcgcctgtagtcccagctactcgggaggctgacgcaggagaatggcgtgaacccaggaggtggagcttacagtgagcagagatgacgccactgcactccagcctgggcaacagagtgagactatgtctctgtctc

SEQ ID NO: 6428 - DNA, 503 bp, Homo sapiens
  ENST00000453399
agatgcaaaatgtgtctctggccagcaggaggaaggaagaggaagtgagagcagcggcagccggcggtgcagcagccggccgacccagagtggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctcca

SEQ ID NO: 6429 - DNA, 858 bp, Homo sapiens
  ENST00000445322
atagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcagggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttc

SEQ ID NO: 6430 - DNA, 591 bp, Homo sapiens
  ENST00000479447
agatgcaaaatgtgtctctggccagcaggaggaaggaagaggaagtgagagcagcggcagccggcggtgcagcagccggccgacccagagtaaaaccttcttggcctctaactgagcagccctccatagaggattattagttcatgcctctgtgcaagaaagaaaaacaaaaacaaaatgcatgagttcattcactctcccatctcccctgctggcctgagagcacctgaacatagtgatggtactgtagccagtcatctgtgcatcctctgtgctctgcccactgcctggcatgtagaatatgcccagcaggggattttcagagctgaccagatgggagagtggtgaaactgaagatcagcccttttccctgcctgtaagcacctctaggaaaagatttaagagatgttgcaaacaaatcactccaacgtatttgggattgctcattgtgatgcctgatctgtgccagcctcttcctaccacatctatgactgttacaggggtaactgttccatcccttagtctgcagcacccggaatggatgtggaatcactgaaggaggtgagtggggaagaagacaagttggatcct

SEQ ID NO: 6431 - DNA, 3669 bp, Homo sapiens
  ENST00000290246
gcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaac

SEQ ID NO: 6432 - DNA, 4121 bp, Homo sapiens
  ENST00000467800
gccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctctctattcctgaatgttttattaagaattttgaacatacacaaaaatagatggaacctctgtatacacatcacccagactcagcaaccatggccagttctgcccatccacttgtttctctcctttatcgctttgaagaaagtcccaagtatcacactgtttcatctgtaaatatttagtgtacatcgtatagtgtataacattgccaccagtccattagcacacataacaggaaatgaaagtagttatttcagatcaaatattccactgatggtgactttctaccaattgtcttataaatgtcataatttctctacagatatataaatgtttatatggatacacacacacacacacacacacacacacacacacacacacacacccccatacccatcttgtctaaaccagagtctaagactggtcttttaagtttcttaattcataagttcccccgcccccccatcccccaccatcttttcctttgcagtttattagctgaagaaccagattgcttgtttggtagtttcctagcatctgaattttgctgattgtttccccgtggtacagtttaacttgttcctctgtcccagatctgtacattggaagagggatctagaggtttgatccagttcaggtttaacttttttcctggccagtgtcatcagtggtattatgttctatcaagaggcacataacgtctggtggtctctccttttgtgataattagcagactgttgaagctcagtgcctcattccatcagtcaactaaggtttgcaaactcatgatattttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgacttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 6433 - DNA, 3678 bp, Homo sapiens
  ENST00000372176
gtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 6434 - DNA, 2158 bp, Homo sapiens
  ENST00000452857
taccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaaacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgta

SEQ ID NO: 6435 - DNA, 2157 bp, Homo sapiens
  ENST00000352077
atgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccatgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctga

SEQ ID NO: 6436 - DNA, 553 bp, Homo sapiens
  ENST00000464448
ccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaaacattaaggccattgtcactgggaaagattgtccccacatgaaagagaaaagtgctctgaaacagaacaag

SEQ ID NO: 6437 - DNA, 1344 bp, Homo sapiens
  ENST00000425546
gaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacca

SEQ ID NO: 6438 - DNA, 938 bp, Homo sapiens
  ENST00000462491
gaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccat

SEQ ID NO: 6439 - DNA, 717 bp, Homo sapiens
  ENST00000481852
gctgtagccgctagccacggtgactactaagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatgcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatc

SEQ ID NO: 6440 - DNA, 1250 bp, Homo sapiens
  ENST00000488853
agccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccaattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggatt

SEQ ID NO: 6441 - DNA, 1168 bp, Homo sapiens
  ENST00000450812
ggaggagccgccgagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccg

SEQ ID NO: 6442 - DNA, 506 bp, Homo sapiens
  ENST00000480042
cgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatgtgagttcctggaacatgctgtattttattactattaacaacaattattactgttattgttaatatattattattgaaattattaatgagtgaggaggacacacagaggaaccttatcaataggtaaatacctcttgaactgaatagctttttcccgcgatcctctgtgagcagagttgcctctaggcagccatctcaccagcaattgcagtgcgtccagggagggaccaaggccagctctactgtttgttgccctgcaactccagaatttttatccagagggaatatgttaaaataggcacaaagggggaaaataactcatccaactgacact

SEQ ID NO: 6443 - DNA, 874 bp, Homo sapiens
  ENST00000469801
gggcggaggctggaggagccgccgagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacag

SEQ ID NO: 6444 - DNA, 749 bp, Homo sapiens
  ENST00000460474
gggcggaggctggaggagccgccgagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatggactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgc

SEQ ID NO: 6445 - DNA, 777 bp, Homo sapiens
  ENST00000497412
aggcggggcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatggactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggt

SEQ ID NO: 6446 - DNA, 653 bp, Homo sapiens
  ENST00000487583
acgtacatccatcatggcctcatacatgagaggcatggtgaccaagaagggctcagatcgcttaggaatgaaggttggggtcacaccatcaggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgaga

SEQ ID NO: 6447 - DNA, 498 bp, Homo sapiens
  ENST00000462593
ggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccaatacctgggctgaatctgctctacactggctaggtgtgcacacaggcacttacagttacagttgcatcgactgatttcccatggggtgttcacattaaaattcatcttttttgtggct

SEQ ID NO: 6448 - DNA, 3574 bp, Homo sapiens
  ENST00000396391
tcccaagaaggcggggcgggcggaggctggaggagccgccgagcggagacccgggagcaggagctgggcctaggtctgcgccctgaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgt

SEQ ID NO: 6449 - DNA, 1832 bp, Homo sapiens
  ENST00000531234
agccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgaggatttcttcaagcaagaattaactttcattagcacattcattgaaactgttcaaaataagccacttttctcttactgttccaaaagaagacgtcagagtcacaaatttaggatgatggcatagtgttgcattacagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctct

SEQ ID NO: 6450 - DNA, 2852 bp, Homo sapiens
  ENST00000265840
cccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctcaaaaataaataaataaataaataaataaataaataaataaataaataaataaataaaatagtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgta

SEQ ID NO: 6451 - DNA, 1990 bp, Homo sapiens
  ENST00000443271
agtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctc

SEQ ID NO: 6452 - DNA, 692 bp, Homo sapiens
  ENST00000524378
ccagttgacacttactttgacaaaggcaaatttggaagcaattacttgaggacagttcatatagcatctggacagtcaacacgggcaccatgaagcacttcctgaggcaatctcctgtaggtgaccttcccagagcctgcccattgccctcaagctgttgtccgagatcctctgggagctggatcacgtacatcccagctctcccgccccttggctttccctcagcttttcagggccaactctttggccacttcactgtttgttaagctcttcccgcagagcatgagcaatatacccgaaagccacgggcactcaataaatgttagtttgaatttcattcatttactcattggaattttcacttttgtactgaagtgaggaaagcacgctgattttccaggctgttctgtctgtctctgtgggatggtggagctggctttcctgtccaacctgagaggaacgtactgtctctctctcctctgcctctccaacaccctgggtgttttgcttttatagaattgtcacactgtttttcaactttctgtttttactgtccttttccttgctagactacaagctccttgtggacagggaggtcatatggcttgctgtgaaaataagttcttgactcatgttcactttttccactgccatatctcccactctcatttcttctgtactgcacggtcagt

SEQ ID NO: 6453 - DNA, 972 bp, Homo sapiens
  ENST00000529675
agacagagccaaaatggaaggcgggacaagggcggcctggctggggcgaggggctggtctgggtccctgggaaccccttgccttgtgggcttcggtctccagggaggagctaggcagccgggctgcggggccgccggactgtggggtcctccgcgcagcgagctgggaggagcggtcggctgggctgttgagctgcgcctcctccaactgctgggaaactccgcacttcaatattggagcatctctttcccgggcaggaaaatacgctgctaacccccagtgggccgtagattggtactatcaattgagtctgtcatttggagagaccaattttgggcaggcatccaggcattgttctgcatctctgcaatgtatacgttttgtgccggtggcttgacaaccgtccttaactggtgctgccaatatggtggaaagcaggaagaagaaataaatgtcttctctgtaagacatcactgtcaagaacactgaaagaagaacccattaacgtagggaacgttgaggactggaacaggttgtagggcgtcttcctacactttgggttataacttccattgcatcaccaccatttaccagtaaaccagcacacacagcaatcagtactcgaaatggttctcttttgcagaaaaagcctgcttttctcccagctttggtgagatagatacgtaatcttcgtaaagacctataaggaattcctctgtggaacaaaattttaagcctccagtacaggatgctgaaagaagcaactctttaatcttgccagcccatgcacagtgaagctgaagtgcttcaatttacagatgttttacatttagggaaggcttttccaacaaagacctaccgcagttacatcacaggctccacctccgcctgccaggctgcttctgcaaggctgttagtaaggatactatgtattgctgtgcttgattaatgaagaaaataaatctccaaatc

SEQ ID NO: 6454 - DNA, 641 bp, Homo sapiens
  ENST00000527036
cgcagcgagctgggaggagcggtcggctgggctgttgagctgcgcctcctccaactgctgggaaactccgcacttcaatattggagcatctctttcccgggcagttgacacttactttgacaaaggcaaatttggaagcaattacttgaggacagttcatatagcatctggacagtcaacacgggcaccatgaagcacttcctgagtccatttccacagatgttggacgattttggcaatcttttcatttgaaccaaagagaaggttatgtaagcaaagcctgaatgaatcagatgttaattcctgagctcagcaaatgtattatggagaatgaggagctgacttttcactgggaagaattcagcattatttaaaagcccatgcagtgattaatctgtcaacttctgagatgttctagaatgaaatgctccatgcacagtcccagaagaaattaggttaaccttagagaaaccaggttgtgggaaaaaatggattttgatctacatttaggatacatgatacccaattgctaccatcagatatattaatggtataaatattcagagcaaaaaggaatagagaaaatattcaatgtatgtcaaaaattacatgaaatataaggaataaatgctatttgatta

SEQ ID NO: 6455 - DNA, 848 bp, Homo sapiens
  ENST00000534236
aagatgaaaatggagctgctgtggcttactgacttagcttagcccaaagaaataccatagcacttattgggacagagtttttaaaacctgtaaatgctccctccctccctcccttcctctcttcctccctagcttcctttttttcttcattccttgcttccccccctccccgcctctcctccctctcctcctttccttaccttccttacttccctccctccttcctttcttcttttctttcttttactaactcaatcatttacttatcgatgaacatttatttggcatctacaatgtaccaggcatcacaaataatataataatattatttattatattattatagtatggtgaataggataaacaccactaggtaaaaccaaacaaaatgcagtagggaatcaggagagagtgaggcgacatctagttacctcactaaatgtttcaggaaggaggggtttgatcattaatgatagtgcaaaagaatagcttaatgtttggcctttagggctgtctcccatggctatactaaagtggataggaggtaaatagcatggccttaaataattccatttctgacctccatataaattgtactgtggcttaacatttgttggataattgagctacagacatctctgcatatagttaacagttttaacataagcattaaaagagaacaagtaccaattagaggttaaatctgacttacttacttattcattcatccattcagcaaattcagcaaagcagaatgggagaagaaaaggatggataaggcaattgggtactcatttgcaattgtgggcatcaatataactgacctggcatataatctactggtcagc

SEQ ID NO: 6456 - DNA, 2583 bp, Homo sapiens
  ENST00000445912
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgt

SEQ ID NO: 6457 - DNA, 3781 bp, Homo sapiens
  ENST00000252034
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 6458 - DNA, 542 bp, Homo sapiens
  ENST00000431562
ctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcagg

SEQ ID NO: 6459 - DNA, 2991 bp, Homo sapiens
  ENST00000320492
tccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 6460 - DNA, 962 bp, Homo sapiens
  ENST00000438906
ctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatg

SEQ ID NO: 6461 - DNA, 582 bp, Homo sapiens
  ENST00000494160
agccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccaggtaagacccaaggcctcggagcattgagagacagcgagggagctggggagggaggagcctacccagctgggaatgggacaaggaaactaggaacaggacaaggaagccaacgggcaggaggaaggagggaggtgtggacaccgattagcctcccaaggatgagtaggccggggccaggtcccagggcttccaggaacaagaggctggaagcagctccatgtcctccctgtgtgagggcgtctagcatctaccctacatgtgcatgtgtgttcacccagctgtccagagactcctctctgcaaaggagaggct

SEQ ID NO: 6462 - DNA, 524 bp, Homo sapiens
  ENST00000492003
gcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggtgagtggtgctctttgggacatgccacaagccctctggcttccgtggggccctccgctttgcaaagaaccttccctcaactcaggcttgggagccgggtgggtgggattgtcagttgcaatctactggggctca

SEQ ID NO: 6463 - DNA, 627 bp, Homo sapiens
  ENST00000468517
aacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctggggctggaggacagagggcagggaggggcagagggca

SEQ ID NO: 6464 - DNA, 563 bp, Homo sapiens
  ENST00000438880
aattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgca

SEQ ID NO: 6465 - DNA, 3139 bp, Homo sapiens
  ENST00000414324
aattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 6466 - DNA, 2240 bp, Homo sapiens
  ENST00000380562
gggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 6467 - DNA, 545 bp, Homo sapiens
  ENST00000480728
ataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctgggg

SEQ ID NO: 6468 - DNA, 3043 bp, Homo sapiens
  ENST00000380575
cggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 6469 - DNA, 3214 bp, Homo sapiens
  ENST00000380584
ggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 6470 - DNA, 3147 bp, Homo sapiens
  ENST00000458204
gcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 6471 - DNA, 3361 bp, Homo sapiens
  ENST00000357036
ggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 6472 - DNA, 558 bp, Homo sapiens
  ENST00000462506
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtcagtgcggaatccctggggctggaggacagagggcagggaggggcagagggcagggaggaacagagccctctccatgccactgcacttggggaggaagggcagggcctggcttc

SEQ ID NO: 6473 - DNA, 542 bp, Homo sapiens
  ENST00000479432
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtatgcagctgtctggacagag

SEQ ID NO: 6474 - DNA, 658 bp, Homo sapiens
  ENST00000417091
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacag

SEQ ID NO: 6475 - DNA, 3298 bp, Homo sapiens
  ENST00000429192
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaagg

SEQ ID NO: 6476 - DNA, 714 bp, Homo sapiens
  ENST00000416107
atttctccccgagatggcgggtctgacggcggcggccccgcggcccggagtcctcctgctcctgctgtccatcctccacccctctcggcctggaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacgcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgg

SEQ ID NO: 6477 - DNA, 542 bp, Homo sapiens
  ENST00000442310
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtaggtggagcttttgctggaatcccaggagttggaccctttgggggaccgcaacctggagtcccactggggtatcccatcaaggcccccaagctgcctg

SEQ ID NO: 6478 - DNA, 2703 bp, Homo sapiens
  ENST00000380553
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcaggtgtaggtggagcttttgctggaatcccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 6479 - DNA, 3109 bp, Homo sapiens
  ENST00000380576
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 6480 - DNA, 474 bp, Homo sapiens
  ENST00000473323
tttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtcagtgcggaatccctggggctggaggacagagggcagggaggggcagagggcagggaggaacagagccc

SEQ ID NO: 6481 - DNA, 512 bp, Homo sapiens
  ENST00000428787
tttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacagg

SEQ ID NO: 6482 - DNA, 2274 bp, Homo sapiens
  ENST00000320399
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 6483 - DNA, 489 bp, Homo sapiens
  ENST00000419398
gttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccggccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgtggggctgccaggtgtatacccaggtggcgtgctcccaggagctcggttccccggtgtgggggtgctccctggagtt

SEQ ID NO: 6484 - DNA, 570 bp, Homo sapiens
  ENST00000477397
agagggccagatgcagtggctcatgcctgtaatcccagcactttgggaggccgaggtgggcggatcacctgaggtcagcctgaccaacacggtgaagccctgtctctactaataatacaaaaattagctgggcgtggtggcctgcacctgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggagttggaccctttgggggaccgcaacctggagtcccactggggtatcccatcaaggcccccaagctgcctggtggctatggactgccctacaccacagggaaactgccctatgg

SEQ ID NO: 6485 - DNA, 752 bp, Homo sapiens
  ENST00000493839
gtgctgggacctgaacttgctctctttattcccacaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggtaacatctgtcccagcagggggcgggtgtgtccttgagatggccacagggcaaggacctcaccctctgtggctgtgttttcaggcgttgggactccagctgcagctgcagctgcagcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatcactctacctgagatgccatctctattgttttgccctgattaactcagcagagggaggggaccctgcagaggggacatggctcctcccactccatcccctccagggcca

SEQ ID NO: 6486 - DNA, 564 bp, Homo sapiens
  ENST00000466878
gtgctttaggaatagatcacattctagctatgcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccct

SEQ ID NO: 6487 - DNA, 590 bp, Homo sapiens
  ENST00000492210
gagggagagagaaagaaagaaagagagagagagagagagaaagaaagaaagaaagagaaaggaaggaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtc

SEQ ID NO: 6488 - DNA, 3452 bp, Homo sapiens
  ENST00000621115
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaaccttt

SEQ ID NO: 6489 - DNA, 3967 bp, Homo sapiens
  ENST00000358929
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggtgctgcaggagcaggagtgctgggtgggctagtgccaggtgccccaggcgcagtcccaggtgtgccgggcacgggaggagtgccaggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 6490 - DNA, 1477 bp, Homo sapiens
  ENST00000372458
gcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgga

SEQ ID NO: 6491 - DNA, 797 bp, Homo sapiens
  ENST00000468865
atcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttccc

SEQ ID NO: 6492 - DNA, 1034 bp, Homo sapiens
  ENST00000464204
gaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggac

SEQ ID NO: 6493 - DNA, 867 bp, Homo sapiens
  ENST00000470968
aaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacaatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacag

SEQ ID NO: 6494 - DNA, 828 bp, Homo sapiens
  ENST00000487209
ggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacc

SEQ ID NO: 6495 - DNA, 1215 bp, Homo sapiens
  ENST00000470769
ggtcagaggaggtttctggctcagaatctaggaccttagctcatcaggctggtcccacgtgggtgggtgggtggcgagtctggggctttacttggctttcccaatcctggtgggtcctgctcccccaggcactgacctgtggcccggacccaccctccaccccctgcacagtacagcaggggcgggcagagggcggggctgctgccagatctagtcagacaggtggagccgccggggcaggagtctcaaagagccaggctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcagga

SEQ ID NO: 6496 - DNA, 830 bp, Homo sapiens
  ENST00000497569
ccgcaggcttggggcctgaccacggtgggcctaaagaagccgggcctcctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactct

SEQ ID NO: 6497 - DNA, 984 bp, Homo sapiens
  ENST00000482302
ggaacctgtgttggcgccctcgccccggcctgggccctgccggcgatgggcggccagcaagcccgatggtgggggagcaatacagcaggggcgggcagagggcggggctgctgccagatctagtcagacaggtggagccgccggggcaggagtctcaaagagccaggctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttc

SEQ ID NO: 6498 - DNA, 973 bp, Homo sapiens
  ENST00000497050
ccccacacccccgtctctggcccccatttgcctacacccgggccttcctccaccacccctgcatttacctctctccctcctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctca

SEQ ID NO: 6499 - DNA, 564 bp, Homo sapiens
  ENST00000478481
tggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaa

SEQ ID NO: 6500 - DNA, 646 bp, Homo sapiens
  ENST00000479439
ctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgg

SEQ ID NO: 6501 - DNA, 726 bp, Homo sapiens
  ENST00000465321
aagtggcaggcaggcaggctggccccggggacttctctctggccctgctccctccgagcgctccgccgttgcccgcctggcccctacggcaggggcgggcagagggcggggctgctgccagatctagtcagacaggtggagccgccggggcaggagtctcaaagagccaggctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgcccc

SEQ ID NO: 6502 - DNA, 417 bp, Homo sapiens
  ENST00000479686
accttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggg

SEQ ID NO: 6503 - DNA, 779 bp, Homo sapiens
  ENST00000496932
ctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgagtagttatatgagatgtgagaacttgaggggagaatgaggtggagaagcccaggttctgaatccccttccctcactcttctctcaggtgatctttattctccgaaagaaagacgggcaggtgaccttcctacatgtcttccatcactctgtgcttccc

SEQ ID NO: 6504 - DNA, 1625 bp, Homo sapiens
  ENST00000621943
ccccacacccccgtctctggcccccatttgcctacacccgggccttcctccaccacccctgcatttacctctctccctcctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgg

SEQ ID NO: 6505 - DNA, 1451 bp, Homo sapiens
  ENST00000413844
aatcagcgggcgccccccgcgcggcccgcccctccccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgg

SEQ ID NO: 6506 - DNA, 3997 bp, Homo sapiens
  ENST00000354666
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttatccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttacgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagtttttgaagctgggaggaaaaagatggagtagcttggaaagattccagcactgagccgtgggccggtcatgagccacgataaaaaatgccagtttggcaaactcagcactcctgttccctgctcaggtatatgcgatctctaccgagaagcaagcacaaaagtagacaaaagtattaatgagtatttcctttctccataagtgcaggactgttactcactactaaactctaccaagaatggaaacaaagaatattttctgaagatttttttgaagattaatttataccctataaaataaaacttgttagcttcgatgaagtcacttcatcttctctcctgccttatttttttaaataagtttttaggtcctgacactgacatcaaatacatgcacaccagaaaggcatttccaccaccgtccccactcattagcgtccagagtgcctttctctctcggctttttttcccccctgagctctagttttaaactttctcctgttaaaaaaattgtacttttatttcatgtaaactgcccctctgaggatttgggcatattttttggaaggtgcctaatgcttaggatagtctctagggtgatgcactgcacctgcttccttcccttcagtgcggccgacccatttctgttgaacagatgtctcctgtgtgatgcccctgactcttacatttatctttctaaatcattttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaa

SEQ ID NO: 6507 - DNA, 2827 bp, Homo sapiens
  ENST00000304434
gcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgt

SEQ ID NO: 6508 - DNA, 761 bp, Homo sapiens
  ENST00000485336
gattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctg

SEQ ID NO: 6509 - DNA, 696 bp, Homo sapiens
  ENST00000465983
ctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagatgattccctggtaaagagaagaaaaacactgtataaagtacagctgtgtgcatctgagtggatgtggggggttctgaacacattgtaatagaagttagtaacaggagtatgggaaggcaaatacaacttcttctgtcagggcacacgcaccgcaggagaatcagatatgaag

SEQ ID NO: 6510 - DNA, 794 bp, Homo sapiens
  ENST00000486973
ctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagatgattccctggtaaagagaagaaaaacactgtataaagtacagctgtgtgcatctgagtggatgtggggggttctgaacacattgtaatagaaggacttctgatcagcctgcatggatcctgcttgactggccatgactttagagagtagtagaagacagaaaagttaatacaccttctaatgaattaccatttagtaacaggagtatgggaaggcaaatacaacttcttctgtcagggcacacgcaccgcaggagaatcagatatgaag

SEQ ID NO: 6511 - DNA, 580 bp, Homo sapiens
  ENST00000370913
ccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagagggggttaggaccaccacagattgactagatcctaaggattctctacctggggctggagttcgggtcaggtgcccgggaagcactgtgcggtgtgggaggatgaatatgtgccaatttggaaagatgagtatttgtgggaaaatgaataaagcaaagtgtaaatcagaggtttaagttaaaa

SEQ ID NO: 6512 - DNA, 3081 bp, Homo sapiens
  ENST00000370918
aaaaaaatttcccagagacacgtggaaccgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagtccaaaagggagcaaccccgtcgatctgcctgtgcctcacgaactgatccttcgactcagcagcagctgccagaaaacaggttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 6513 - DNA, 2875 bp, Homo sapiens
  ENST00000542638
aaaaaaatttcccagagacacgtggaaccgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 6514 - DNA, 3994 bp, Homo sapiens
  ENST00000508821
tccctccggccctcggcgggcacctggcggcggcgggcagggggcggcgctgcgcgcgtcacgcggctgggtgggatagcgggcaggtgacacccggcggcctcctcccctttccaacccagtcggcggccgggacagcgggggccgctgtgaggagctccgcgctcgcgctgccagtcgccgccctctctcccgcgcgcgcccggcgcttcggctccgctccctgtgcggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgta

SEQ ID NO: 6515 - DNA, 4165 bp, Homo sapiens
  ENST00000505959
cagtcgccgccctctctcccgcgcgcgcccggcgcttcggctccgctccctgtgcggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctggttgattcttacctatcaactagaaattgcaagtctaccaaattcaggaaggaaatgcacacctcttggcacctaccacagatgaaattatagtcaaatttacaacgatttcagcaaagatacactgtttcatcatttgcagctttctcagcagactactaaagaccaaatttatctcactaaaagtgttcccaacagtttttcctttgaggaatgccaaggttctttcttcttcatttcattagtacttggaatcttaaagatgtactctttgagccagtacctgctacttaagaagagaatactctcttagaagcagctgatggaaaagcccattaatattctatatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatg

SEQ ID NO: 6516 - DNA, 1034 bp, Homo sapiens
  ENST00000504455
attataaactcatttctgttttattttactgaagaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataactttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataa

SEQ ID NO: 6517 - DNA, 737 bp, Homo sapiens
  ENST00000511799
gagccgcatcctgtcttggtggctgctgctggccgggaggaggctgatgaatacagagccgtggaacaggtcgtgccggagatggaaacaggaaagcctgttgttttgtcgtcccagatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 6518 - DNA, 730 bp, Homo sapiens
  ENST00000507047
agtcggcggccgggacagcgggggccgctgtgaggagctccgcgctcgcgctgccagtcgccgccctctctcccgcgcgcgcccggcgcttcggctccgctccctgtgcgatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 6519 - DNA, 595 bp, Homo sapiens
  ENST00000514809
gccgccctctctcccgcgcgcgcccggcgcttcggctccgctccctgtgcgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagatactgttttaaaagaagaccttcccaccatcagactgaaagaattttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccg

SEQ ID NO: 6520 - DNA, 3827 bp, Homo sapiens
  ENST00000425382
aacccagtcggcggccgggacagcgggggccgctgtgaggagctccgcgctcgcgctgccagtcgccgccctctctcccgcgcgcgcccggcgcttcggctccgctccctgtgcgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgt

SEQ ID NO: 6521 - DNA, 1234 bp, Homo sapiens
  ENST00000568449
gaggaagaggtcggtccggccatggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacc

SEQ ID NO: 6522 - DNA, 5613 bp, Homo sapiens
  ENST00000570069
ctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtaccgctcactctcatgcccacagcagggctggctgggacgggggttcaggggaggtgggcacacttctggggttgctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctgggtgggttctctggctgagcaggtctgacctcaggggaagggtgggtggttgcaggggaagttttaggtagctgggagaagaggggcttctggctggcagatggctggcggttcctgtgctgagtcctgaacacgtaggccccaggggaggcctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacgccatgtgggtgttagacatcaactctacatttattgcagtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcgggtagaatctcttgttctgcagcttggtggctgccacacctggaagggaggggcccagcctgaaccccaggcagggaaggggccagctactgggcgcagcccctcagacctcacgctacagtcacccgggtgggcagctggcacagctgaggcaaggcagggtgcacgcgctggccctgccactccagcctggcctcactgtcccaccccctgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgatgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagagctccatggggctctgccctgcccacccccaggcccgcccgcagtgcagtcccagcaggggctgggccccacgctcacactcgtcttcctctccgcagcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgcccgtcaggccaggcagctgccctcagggtctgccaaggtgggggtcaggggccatgggggcaggtagctctgcctgcaaagcccacaagcatgtcagatcacctgggctgcagacagacaaacacctgagctgttctgaataccttcaggttcctggcctccctgagcaagtgcagaaatttttaccttcaaggatcagggtttttctgtttgtttgttttttaacacacatatatgtg

SEQ ID NO: 6523 - DNA, 480 bp, Homo sapiens
  ENST00000561564
aggcttgctgttctgcaaaccagctgtggcctggtggcccatggccataggccgcagcctcctgtgaacaactgtgccacacgttctcatcttcagatctctggcccaacccactgggtgccctggatctcccccgagaccaccgcccggccccacctggctgtcatcgggctggatgcctacctgtggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgca

SEQ ID NO: 6524 - DNA, 434 bp, Homo sapiens
  ENST00000565326
gctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcag

SEQ ID NO: 6525 - DNA, 4586 bp, Homo sapiens
  ENST00000561903
gtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctggtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcggcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgcccgtcaggccaggcagctgccctcagggtctgccaaggtgggggtcaggggccatgggggcaggtagctctgcctgcaaagcccacaagcatgtcagatcacctgggctgcagacagacaaacacctgagctgttctgaataccttcaggttcctggcctccctgagcaagtgcagaaatttttaccttcaaggatcagggtttttctgtttgtttgttttttaacacacatatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggcatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaggctgggccacggacccactcaaagtggggactgcaggggccgcaccggtgcccagccagggctccagaacgcttcaggagcccgtacctcactccaggatctgagcagctcaataaaacccaggtagatcctgtgaaacgccacccaga

SEQ ID NO: 6526 - DNA, 549 bp, Homo sapiens
  ENST00000564182
ccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctggcctcccacaagacctggggctcagggcagccgcttccccacccagcacagcagcagaggggccctagagcccccacagaaaggactgtcccagcctcgggag

SEQ ID NO: 6527 - DNA, 5910 bp, Homo sapiens
  ENST00000254528
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaacagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttccttatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaacttttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccacgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgca

SEQ ID NO: 6528 - DNA, 1544 bp, Homo sapiens
  ENST00000308080
ccgggagacgcacgccaggagcttcctccgttggaagtcccttccgctggcgacgtgggcgctgtggccgcggccctcgtggagcctgagccctcctcacggcctccgcgcagccctggggccccccggcagggtccctcggcagcccgcgggagaggccgtggggccccggcaggagtgtggttcagagacggtgcgggggtcggtggcctcaggtccctttcagtcacttgcgacgcacccgcggtttccgcgtgctgtgaaatcgggaattgttgatgccggagccaagagtgaggccggtttggaaagcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagg

SEQ ID NO: 6529 - DNA, 775 bp, Homo sapiens
  ENST00000583776
gggcaggggtccccggcggcgtccgggtggcccgcggcgtcctcggaagatgcgggcggacgcccgtgtgtcccgctggcctgacgtcgcaggggtggccgcagagtcctcacggggaccccgctcgccgggactcatggaggggaccctgacggggcagtcagggctgaggtttcctaatcccgtgtgtttctttctccccgacgcccggcagaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctcca

SEQ ID NO: 6530 - DNA, 9570 bp, Homo sapiens
  ENST00000554922
ctgggcatccacttgacagccggcggcgctcgcggccctcagcatgttccgcgaggcgagggttttcctcccgcctgtgggctgaggcggcggcggcccccgaaacgagatgcacctgacgggcgcggcttagaggacgcggctggcgggaagtcccggcagccagcgggagggctttcgttgccgggccgccgccgcctcccgtcgccgccgcgggcccgagcgggagcggcgggtgggcgccccgacatggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcagggagtagtaagaggttccaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagcataaccagtgattgaacctggtagttttaaagctctaaatagctgtggctgaaggactgattatggggctaagaagcttgaaacgtaagttggtacttgttcatcagtggattctcctaaattaagccaaattttgaaatacatgactattaagtttctactcatgtatttacagtcagtcaataaattaaaggaggaaaaaaatccctgaacaacctgcccataaaaagaaaaatactctacatttgagcctgctgcagttttaaattttccctctgggtcaagtttgccagcttttggctacagagaaattatatttccattacagtgcaggtagaaactctgtaaccttaagcatgtaaactacatagaataaaactgtttccactgcatttctgtccttcaaagtggccaacctgattaagtcagccttaatcactgctgctgtcagtttcacgactaaaggtcatattgactaagtagtcatcagctgaccacctcgctgtatcagccagcaacgaggggaaggtgaagaaacatgataggccatatagaatctgccctatgtttacttttttaacccagataattatttttgtgtgcagtatctaagctcctgattgtgtaacctgggacttctggcaccttttgttccattcattttatgtataaaatgcatgccaaagcacactgtgccctctggtacccttgcttccaatcgccaaccatgctcatttccttcctttttttgtggtccctttttgtggtgatcattttaaaccacgtcatccaacaaatgttttatggtcaaccttagcttgttcataagccatagcaactgaaagattaaactcttaaatatgtgtctgggcagtggctattaaatagcaaaaaacaatcagattttagtattttattatttccttgtaaaatggctgaactaaattaaacccttgtttcccatttgttctataatttatagtgaaactgagaacaaaactatctttataaatgatagctaaaagtatttccagatatttaaacaatttaaaataaatttcttctgcagagatgcaaagcatctcaacactggaatgaacaaatgccttaaattcaatggagtaaacctttagaatgaagaggaactgtcatttcacccaagccgaagacaacagccttatgcacttgtgtgctctgtctttgctgcttctcgtgtttcaagcctttcctgtgggatcagcacagcaaagtgcaacttaccaaatggtttaatgactggttaattctttcttctcccaatggaaaagcaatggcaacacaacagtagactgctggcttgacaatcttaaacgtgagcctttgcacatgtaggtttatcatcatttgagtatacgactaagcaagtcaatgaactttttttttttttttagcagtttaatttggtcctgagaatgttgcagtctttattaccccttttgcattaatccacttttctaaccaccttttaagctttaatttttaacactatacaccaagtctttgaaatcagtgatctgttatttaactctaaagcatttgacacttcttgccttaacagttttaaaaaccacacacaaaaaaactctgtaagtaatacagtaggccaaaagtttcatcctatctatcttgcagtttacctatctgatctgatctctgtaattatagttctgtcatttaaaatatactatttaaatctaatttttacatttcaaaaattatcttcagtagtaactaagtatattttctgtggattctgagaatgttatttttcagaatgtgagaatatatatgtacatttataatcttgtgactttaaagtctgttttcagatacagtatgtaaatacttgtaaaaaaatttgtataattttgtgataatgtagtttcccaaaaaaattatttagaaggcattatgttattagtaaatgagagcactgta

SEQ ID NO: 6531 - DNA, 3556 bp, Homo sapiens
  ENST00000553973
gcgagacttcgtctcaaaaaaaaaaaattcttcttccaagattcaagttgtgtcatttcaccttaataactggaggttagttaagctgggctgtgttctttgcttaatattaagacaacgttttttccagatggaagaaaactatcttaatgaattgttagcttattaattatgtaatgctaatggcttttaaaagctgagatgttctgactgggtgttgtggctcacacctgtaatcccagtaccttgggaggccaagggggaaggattgcttgaggccaggagtttgggaccatagtgagaccccgcctctatttaaaaaattaaattttgttttgttttgttttgagttggagttttgctcttgttgcccatgctgaagtgcaatggtgcaatctcagctcaccacaacctgtgcctcctgggttcaagcgattctcctgcttcagcctcccgagtagatgggattacaggcgtgcaccaccatgcctggctaattttgtatttttagtagagacagggtttctctatgttggtcaggctggtctcaaactctcgacctcaggtgatctgcccgcctccgcttcccaaagttctgggattataggtgtgagccactgggcctggcctaagaaagtttttttaagccattagacgtttttaaaggaattgggagatgacaattggggaaatatttaaaatttaagtaaaatataaagcttccttatttcatgtaacccagacaatctcagtatacatgatcagttgtgtctgacaggtaaatctatttgaggccttatcacacgttacttttaagaactagaaaggaaaagtcactgatcttaagtatttataatacttcatgtggtctaatactttttacgttttgttttgattcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagcataaccagtgattgaacctggtagttttaaagctctaaatagctgtggctgaaggactgattatggggctaagaagcttgaaacgtaagttggtacttgttcatcagtggattctcctaaattaagccaaattttgaaatacatgactattaagtttctactcatgtatttacagtcagtcaataaattaaaggaggaaaaaaatccctgaacaacctgcccataaaaagaaaaatactctacatttgagcctgctgcagttttaaattttccctctgggtcaagtttgccagcttttggctacagagaaattatatttccattacagtgcaggtagaaactctgtaaccttaagcatgtaaactacatagaataaaactgtttccactgcatttctgtccttcaaagtggccaacctgattaagtcagccttaatcactgctgctgtcagtttcacgactaaaggtcatattgactaagtagtcatcagctgaccacctcgctgtatcagccagcaacgaggggaaggtgaagaaacatgataggccatatagaatctgccctatgtttacttttttaacccagataattatttttgtgtgcagtatctaagctcctgattgtgtaacctgggacttctggcaccttttgttccattcattttatgtataaaatgcatgccaaagc

SEQ ID NO: 6532 - DNA, 3600 bp, Homo sapiens
  ENST00000553526
atttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagcctttt

SEQ ID NO: 6533 - DNA, 5910 bp, Homo sapiens
  ENST00000380664
atggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactga

SEQ ID NO: 6534 - DNA, 770 bp, Homo sapiens
  ENST00000555823
gggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagaatcagctactgcaaagacattccaagctttgtcattcaaatggacttctctgcagatagcagttatctccaggt

SEQ ID NO: 6535 - DNA, 354 bp, Homo sapiens
  ENST00000553320
agttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccggcaagatccttgttgggacaaggaatgctgaaataatcgaagttggagagaaaaatgcagcttgtaatattttagttaacggtcatgtgga

SEQ ID NO: 6536 - DNA, 3925 bp, Homo sapiens
  ENST00000553281
cagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaaggttatattcacttatatttgcacagacatttaaatttgatgtagcggtcattggggagccagtgaagggatttaaaggagctattgagtttgcagtgagtggagaggaagataatctgtagtacagtttactgacatctgtgtcacttgaatagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaagtatttacaagagaggattttgaaagtttccatcacaaagaaatgataaatgtctgaggtgatggttatgcgtattaccctatgccctatagatatgtataattatgtgtcaatttcaaaataaaaattcaaaactacaactcctatg

SEQ ID NO: 6537 - DNA, 627 bp, Homo sapiens
  ENST00000553962
ctccgtctcaaaaaaaataaaataaaatgaataaaagttgtaatattttctttctaccttcctgctttagaagctctcaagatgaagagggcagtctagtggaccacagaatgggtcatctttgggaaggtgtgacaagacacctctctgggagggatggtgtgagaggctcagtgaaggcactgagtgctgcatgcctttcctcctccccacttctctgttgcaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccatt

SEQ ID NO: 6538 - DNA, 5197 bp, Homo sapiens
  ENST00000359543
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaagaaaaaagaaaaaaaaaatccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttcttttttttttttttttttgagactgagttttgctcttgttgcccaggctggagtgcagtggcaccatcttggctcaccgcaacctctgcctcctgggttcaagtgattctcctgcctcagcctcccgagtagctgggattacaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactgctgtacaacattcagtgcccacatccacctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactgga

SEQ ID NO: 6539 - DNA, 781 bp, Homo sapiens
  ENST00000536829
ggcctgggagtccttgcagggtggcctgggtgactgctcaccagcccggccctccccagggttctgggccagagcctccctggccgttggagcgggagctgtgggtggaacacttctgaattgggagattgcctcggacctccagacgccgaacatctcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccat

SEQ ID NO: 6540 - DNA, 3582 bp, Homo sapiens
  ENST00000342147
agagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgtaagtttcctttcctgccactcacgcagaaacctgggtcctgcagtcaatagaagtgggttgtattggtctgttctcatgctgctgataaaggcataccagagactaggtaatttataaggaaaatgaggtctaatggactcacaattccacatgtctgggaggcctctgcagaaggcaaaggaggagcaaagccacatcttacatggtggcaggcaagagagcgtgtgcaggggaactgccctttataaaaccgtcagatctcgtgagacttattcactaccacaagaacagtatgggataaacttgctcccatgattcagttacctcccaccgggtccctcccacgacatgtgggaattatgggaatacaatacgagatttgggtggggacacagccgaaccatatcacaggttgagaaccctgccaaagttctcaatgttgaacctgccaaggttcaaccacgattcggggttgtcctccctgcgaaggcacacacatcttctgacccaagggctgaggactcttggcctaaatgtgaaggttcaggccgtcccatgttcaggttttggtggcaggtcctggcaggcagggacgtttgtcctcccatctgtgattctttcatagagcctggctctaggaagccctttgaggatgttgtgtgacttcagctttcctctagatcagagttctcaaccttgccactattgtcattttgggctggataatcctttgttgtaggggcctccctgtgcattgtaggaagttcagcaacgtgtctggccttatctgctagatgcagtagctcccccacccctggttatgacaatccaaaatatcttcagacattgttaaatgtcccatggagaacaaaatcaccctctgttgaggaccgctgccctagatcttccaggtgacccatcccaggtgacctctgcccccaacccctgacacctccttatcaaccagggtcccttgttgctagcccacccggccatgtcctccccagcagagctcatgcatggaactttccagactctacctatgcccctatgaaaaatttaatgtttccctttagtatccagcttgcagccatatggcaggaatgtattggataaataacctcttggcatagattaatatccctccaaacagggagtgacatcagggaagcttcttaacagcctatacactgttccaaagacctggcttccatcctgctcattttagactgcagagataattaaagggcagaaacattgctcagaaagccaaaaagtacaccatacgagtggccaccaactctgcctacatatacggctcccgttgatggatcatcatgacaatagtaacataaactataatgcctgtcacttagcgatcactgtggcccttttatgcatgtcatctcatgtgatccccaccccagctgtaccaggtagggcaccgacatctccttgcaccgggttacaggtgaaggaactgcgcctcagggccattcgggcacttggcagagtttacagtgcagtaagcagcagagccaggatttgagccattccagaggctcctggtcctagagcctgtcaggggagatgagcacaataatcgcatttgggttctggagcttcttgctgagctgctgtgagtggcctgggcagggaccacattgctgctatggattatagcagtggtccccaacgtttttggcaccaggaaccggtttcatggaagacaatttttctacagactggggagggggcattgcagggggatggtttcagaatgattcaagtgcattacatttattgtgcactttattattattacattttaatatataatgaaataattatataactcgtcataatgtggaatcagtgggagccctgagcttgttgttctggactagacggtcccatctgggggtgatgggagacagtgacagatcatcaggcattagagtctcataaggagcgtgcagcctagatccctggcatgcacagttcacaaggttgacactcctataagaatctaatgcccctggtgacctgacaggaggcagagctcaggcagtaatgtgagtgatggggagcagctgtaaatacagatgaagctgccttcactggctgctcacctcctgctgcgtggcctggttcctaacaggctacagacaggtaccagtccatggcccatgggttggggagtcctagattatagtatttggacccaccattccaggagctcactgtgaaataaatgggaccgaatgttcttttagaatctcctttttctatttcttcccatctagtcctttgggatcctgaaaaggtcccagacttagtgaaaaggatagacagacattaggggcaggaaaaccatcagccttagtgaatcgtatccagcacccccagggtatattatcatggcacatactaagaagatgcagatggactttttgtccatcggtgagtctgagggtattcattatgtatttggaattgtgcttggcaactggaaagtagaaggaaggccatcttgggcagtgggggaagggcagcagccaccaaagcacacagggaaatgaatgcttttggctgaagacaggagaatcttgtctggtcatcccatccattgcaatgtttgtttgtttgtttgtgacagggtctctctctgtcacccaggctggagtgtagtgttgcgatcatggctcactgcagcctctactgcccaggctcaagcgatcctcccacctcagactcctgagtagctgggactacagtcacacaccaccatgcctgactaattttttgtatttttttgtagagatgggttgccccggctggtctcaaactcctgggctcaagcaatcctcccacctcggcctcccaaagtgctgaaattataggcatgagccactgtgcccacccctgactgctattacttccagcaactcagcctcatcttttctcccatactctctgagggcctggaccacctcttatcctttgggagaaagtagcagggcatcacctggagccggttagaaatgcagaatcctggccaggcgtggtggctcacgcctgtaatcccagcactttgggaggccaaggcaggtggatcacctgaggtcagaagtttgagactagtctgaccaacatggcgaaaccctgtctctactaaaaatacaaaaatgagccaggtgtgctggtgcatgcctctaaatcccagctactcgtgagactgaggcaggagaattgcttgaacccagtatgggagggttgcagtgagccaagatcatgcatcgcactccagcctgggcaacaagagtgaaactctgtctcaaaaaaaacaaaaaaagg

SEQ ID NO: 6541 - DNA, 3395 bp, Homo sapiens
  ENST00000297375
tctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcgggcagaaggctctgtagagggagatggcatcatctatcttcctttcctttttcttttcttccctatttttttctttttttcctttatttttttcttttcttggagtggctgcttctgctatagagaacattcttccaagataaatatgtgtgtttacacatatgtctgcatgcatgtgaacacacacacacacacacacacaccaggcgtgtttgagtccacagttctgaaacatgtggctaccttgtctttcaaaagaactcagaatcctccaggatctagaagaaggaagaaagtgtgtaaataatcatttcttatcatcactttttgtcttttcttgttttttaaaatatacattttatttttgaaggtgtggtacagtgtaaattaaatatattcaatatatttcccaccaagtacctatatatgtatataaacaaacacattatctatatataacgccacactgtcttctgtttagtgtatggggaaagaccaatccaactgtccatctgtggctgggacagcccagggggtgtgcccacggctgacccaggggtgtgcacacggctgagctgggagtcccgctggtctccctgaggactgagggtgaacttcgctctttgccttaaacctctttatttcattgcagtaatagttttacgttgtacataatagtgtaaacctttttaaaaaggaaagtataaaaacaaaagttgtaatttaaaagtctgaataaccatctgctgcttaggaaactcaatgaaatgacatgcctttttagcaggaagcaaagttggtttctgttttttgttttctttgttgttttagtttataaaacatgtgcattttacagttccagtatcaaatatttataatcttatgagaaatgaatgaatgtttctatttacaactgtgcttatcaaaattgtgaacacccccacccccgcatttttgtgtgttgaaattcttgaaggttacattaaataaaacaaaatctctttattataaaata

SEQ ID NO: 6542 - DNA, 13168 bp, Homo sapiens
  ENST00000366844
ggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttattccgtaaaagttctatatacaaatgacaacccatagtttatcatgtaaatctgatttaactgttcccttcaattccaagaaagatttcttcagcagtagatgacaattctaaaagcataaagaaataactaataaaggagatggatgatgttataggttggtttggttgggttttagtaaatagttattcttctaagaaggcttagaaaatcgagaattgaatagttggtactttgaattccataggaaaaagcactcagaagaaaaagtctacattggctagtgtttagattgagagttaattttcccatcaagtccaaaagtttccatccaagtctatagaaactgagagaaaaggttcttggcttacacttaaaatacacattgttgcaaccatataagagagatacattacagaacgcttttaaaaatttggtctcttaagcgcctaacagtccatgctttagtcacatctgtgaaacctcttttctttttttctttttcttttatttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaa

SEQ ID NO: 6543 - DNA, 3655 bp, Homo sapiens
  ENST00000358675
tcctccttcatgtttttaatacagccactttgactgtaaacaattaaatgtatgtgttcactgttactgaatttactgtctcaacacttaaggttaatgtggattattttgggtctgatatttcaagtagtactaactgccatcctatatactagtttgttttttcagggacgcttacctctcttccaaattttataagtatttattttgcttatttaccaaatccccatgaaaaaaaaaagtcttaattagatgatctgttgcatagttctattactaaagctctaacctaaagtaagtagttatatatacttggaccttacatttcagtatctttcaaaaactgatctagacttttacaactatgataaattggactcattaagtaaatacatgagtcagtttaatttagcatggcattctgcgtaccttcccacataaaataatatcactcagctctattgttgatggtcttacttaacatttctctctctcaggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactg

SEQ ID NO: 6544 - DNA, 3308 bp, Homo sapiens
  ENST00000635051
gccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagtgttctatttagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaat

SEQ ID NO: 6545 - DNA, 2758 bp, Homo sapiens
  ENST00000366843
cggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaa

SEQ ID NO: 6546 - DNA, 713 bp, Homo sapiens
  ENST00000498108
agaaaagtgaaaaaatgttgttttatgttctaatcagccctacaattttgataattttttaagaaaatggcttttttaaagaaatgtatttaaatctggtgttgggttggtaaatttgcaattatttatgaactcattaagtattaagaatgttgtttacctgtcctggaaatctcatttatacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaataca

SEQ ID NO: 6547 - DNA, 578 bp, Homo sapiens
  ENST00000483952
caagaattaattgtttaagaatcaaggaagtacaatagaatttcaggattctgatatttattttgagttgttcctatttttttccccaagagggactatttggatttagattaaatgttgaaatacatgaacatattataagttatacttactgtttttatcattggcactaaaaaataatttaaaacagtgtcgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacct

SEQ ID NO: 6548 - DNA, 807 bp, Homo sapiens
  ENST00000497899
caggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactactttaa

SEQ ID NO: 6549 - DNA, 888 bp, Homo sapiens
  ENST00000391874
ggaagccagagtcacttcgtaaattaaccttggaagtgacattccatatatatatatatgtattttttttcccatattctgttcagtagagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctg

SEQ ID NO: 6550 - DNA, 665 bp, Homo sapiens
  ENST00000284563
ggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagcccagagcaaggttactgctacccaggacagcactaatttgcgatgtattttctgtgggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagag

SEQ ID NO: 6551 - DNA, 5520 bp, Homo sapiens
  ENST00000302351
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 6552 - DNA, 5381 bp, Homo sapiens
  ENST00000510316
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttca

SEQ ID NO: 6553 - DNA, 571 bp, Homo sapiens
  ENST00000509284
aacagcacacttagttgggtgttagtccagaactgactatatttgcacagaagagccataaaaattgctaccagggtggtggtacataaaaaatgacaatgggcaggctggctggaatccttggaacaagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtc

SEQ ID NO: 6554 - DNA, 1405 bp, Homo sapiens
  ENST00000508331
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctctggttttccaagaattgatataaagcgggaagaacagaaaacagcagtcataagtatgctactcaaaatattcttctttttatgtgccaaatcctcacattggaagctgtcccgagcaagacaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttct

SEQ ID NO: 6555 - DNA, 584 bp, Homo sapiens
  ENST00000509127
gcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagagtggaaacaaaatgtcagtcagt

SEQ ID NO: 6556 - DNA, 2024 bp, Homo sapiens
  ENST00000537006
cggcacacaaggcgctttctagctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaag

SEQ ID NO: 6557 - DNA, 5657 bp, Homo sapiens
  ENST00000618628
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 6558 - DNA, 2982 bp, Homo sapiens
  ENST00000261488
gcagatccccgctctcccgggcgccgctactcacacaggcttccagccgccacggggcgtcctctgtctgctgcagcggcggcggcagcagagggaacggcgactgcagcccggccgcgtctcccagctccgtgcccgggacagagtccgggagaagcaaaggaggaggaggacgccgaggctaggaggagccgcgccgcgcccggcgccccactccgcgcagcgggttgcctccgctccccatacggcggccccaggtcctttgctgccagcatgatgtcgtatttataatatgtggaggagagagagctcaccatgctcaggtaaagggatggtatgtgcaccacaaataacaagcagaagcctctgatatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagctgtgtgcctttgaaggaattaaaactacctaactgcgaagagcaaagcatctctggaaatgaaaccatgtgaacctggccagggcggtgcgacggggaagcaggaggtgtggggttggtccagcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaaaaagaaaaagaaaaagaaaaaaagaaaaaa

SEQ ID NO: 6559 - DNA, 413 bp, Homo sapiens
  ENST00000482207
tggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggtactttgcattacataaggagttttctaggcattttgttatgttttgtgatgttaatatgagcttattccctttggccttcatgcaaaataaagtcttcatagtttggggctggaaaa

SEQ ID NO: 6560 - DNA, 732 bp, Homo sapiens
  ENST00000486853
ccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtcaggtgctcgttgggctctgcagcagcctggtatcttccagcgtcttagcggggctttacataggtgttatcttttatattaggagtcatggctattggccaactatattagctgaaaaaaataattttaaaactttttattaaagaaactttt

SEQ ID NO: 6561 - DNA, 7442 bp, Homo sapiens
  ENST00000360971
ccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaagtgaaacctttatttatcttgatttcttttttttttttttttttttttttttttttgagatgctctgtcacccaggctggagtgcagtggcaagatcttggctcactgcaagctccgcctcccaggttcacgccattctcctggctcagcctcccgagtaactgggactacaggcacctgccgtcacgcctggctaattttttgtatttttagtagagaatggagtttcaccgtgttagccaggatggtctcgatctcctgaccttgtgatctgcccgcctcggcctcccaaagtgctgggattacaggctcgagccactgcctccagcctatcctgatttctactgtcatgcctcacatcagtccttttttttttttttgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacatacgtacagaa

SEQ ID NO: 6562 - DNA, 3107 bp, Homo sapiens
  ENST00000513998
cgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaacct

SEQ ID NO: 6563 - DNA, 1633 bp, Homo sapiens
  ENST00000459624
aagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcggtaagtatcgtcaagaagtttggtccagtatgtatggtttgatagcaccctctgcatagcatgtgctgtaaaaatacttaataatcaaattagaatttaggagtgggggtaggtaaacatatgttttaattctagggggcgcatgtagatcttttgtgatatatcttttctctttctagtttttgcattttccactctatttttaattccttggagctgtgacttgacttgggtgcaggtgtggtgaagtctagttagttgacttgggtacgggtgtggagaagtctagttcagttcttgagcatcctgaattagggaatctgtgctgttaactctagcagtgaggtgatgagcacatagtaaaccaatcacaatgtacctttttaaaaatacaattcagattgtttaaatgtagggagaaaaaagatttcttggtatgaaatgaatatattacactgtccttttttacttccatgttaatatgtcattattataaaaagataaaaatactagacaagttatgaacaaaattgataacatccatgagggcacctgtaatcccagctacttgggaggctgaggcaggagaattgtttgaacctgggaggcggaggttgcagtgagccaagatcacaccatcgcattccagcctgggcaacagggcaagaccctttctcaaaaaaaaaaaaaaaaaaa

SEQ ID NO: 6564 - DNA, 3233 bp, Homo sapiens
  ENST00000259486
cgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 6565 - DNA, 3271 bp, Homo sapiens
  ENST00000427067
gtcccccgggacagcggccccctgactacatctgcactggagaaatcccaaaagcaaacggccagtgcaaacaagagcagtccgcagcagccgtcccgagcacagctcccaggtcgcggggctgcagcccaggccgcgtccgcagcgcccgggcaggaacagacgccgagactcccgcagcatgacccgccacgccgatcggataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 6566 - DNA, 3647 bp, Homo sapiens
  ENST00000523861
ttttagtagagacggggtttcactatgttggccaggctggtcttcaactcctgactcagctgatccacccgccttggcctcccaatatgttgagattacaggcgtgagccactgtgcctggccttatatatttattaaataacgtatgaagtaatcttttgtatagtttcctaaaataacctatactatagttttgcatgttgtaaaatttttaataaatgctattatactatatgtatcctgcaattattttatcattatgtttttgagacttaatgtatattagtacatgaagttttagctcacttatttttactgctaatacagtagttaatatttaattgtataaatgtaccataagaatttttttccattttcctacttgagaacatttagtaatttgcaaatgttagctcttacaacaatgttgccacagacattactggaaatgtcttcttgcacgcatatgctagggtatacagtgaagggtagagttgctgactcatgctgtttcagaattgctgagtcattacgttttagctttggtgaaaagtgatttcataaattagtttgggaatcacttcagtgtgcctagagattaatctgaaacatttaggcgctatcctaatttacttacacatatatgcccaagtcatcatcagtacccacatgggaaattggtactgtggtgactatccacagttttaaggaaggaaacagagattgaagaaggtgcttacaaacatagaactgctagaggtggagcccagaatgtcagtttgagagaaaacagttaattcctcgaaagaatgtatgatatagatggagtttagagttcgcttttgaatttagcagggtgctaagtcgacagaagggcacagagggaaagaacatttctgatttgctttcttttttcctttactggttttcacacatgaagaacaagttggatgaactcaacaaacggcttcatacaaaagggtctacagaagctgaaaccaggaaattcagaggcagcagaaatgaaaacaaggaaaacattaatggaaattttgaacctagaaaaggtttggtttgagttttgaaggaaagtctgggttgttttactgcccctaagtactactgttacgatttgctggtgttttatttgtttattatatttcatttatttaatattgtcagattatgttctaatccttaggggtgggtccccaaatttggcagcttaactaaggcttctacatttactgcaatgctggagcagccgaactacccagaacaggcttgtgttgtaatagtgtgggccgctttgtctcaaatccgcagttctatctgggagggtcttgcaaagtattctacgaagacttttctccattacttgcatagaatggtaagactttaattaaagcaacatgtatacattatttaataagtgtttttcagaactgattttctctagtagaaaaaatagtacaagaatttatttttttttaaatttatcacttaaggaattgtgaattgcctaagcctcagtctctaaatattttggtctgtagggccccacatttccaagaatctgtggaagttttgactttagcctatccaaagtgggcagatcaagctccaggtatttattgcagagtgtggaatgaagattttcatactgaactcccatctcttcttccgcaaagagtaaagcttcagacctttttttttcctaagaagagagctttcctttggaggtctgaatctgcactgggggtcttcattgagttctttggtaactgatgaacttccctcttctgtacttagaagaccctcttgaatgcccacttattttatctatacatgttcctttaagttcttacctaaagacttttcctctgtatgacaaagctgcttactttaaatgctcattactactcactttttatgctgaaggaatgcatatttgagttgctgtatgcatataatgatcaatgtgtgccttcttcttaattaaatcattggtgtacctgataagcctcttcaggggtcaaaataattaattctacagaaatccaatcctattggctttccattcagctgaatcatttcaaaatttattacataatgtttcctttatatacaaattgtaaattctttacaactaaaaaaagcattctgtaaatacagcatttacattatggttttgataactgtaaagcttgacccatggttaggtgatcagatcaaccacaaaagtgttaggaaaactagcttgattaaattaaggagaaggtgctatattaataataagtaagctagccattttaggtaacttgactcttccaacatttctttaacatttgatgtaaaatttaatatgcacctaacacagtttattttttttcttttttagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagttt

SEQ ID NO: 6567 - DNA, 1695 bp, Homo sapiens
  ENST00000522167
agcattggaatttggggcttctcccttctagtggagttcggaggatgaaaattggctgactctttggcagttctgttaagaatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgt

SEQ ID NO: 6568 - DNA, 2667 bp, Homo sapiens
  ENST00000522826
atggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 6569 - DNA, 2651 bp, Homo sapiens
  ENST00000075322
agtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 6570 - DNA, 666 bp, Homo sapiens
  ENST00000518109
tgattcaaagtctgactgttcatggtactaaagcatttctgtctgagaaaaacattcctgcatttaatttgttggtggcagtgtccttatatgacaaaaccagtctcacaattcattataaacaataacctcagccgggcatgatccaccatgcccggcagagaaaatgaatcttaagatatctctgcccctcttgggcccctcgccctttcttcttcatgtctcttccatgagggctgaatatttgtcatacacttttgagcgtgaaaagggacactattaacaattataccagggcaacaggcataaaactgtaacatggggccagcctggtttaacttcatatgctccttaaaggactttattgatgccaccttcactccatttccagtattcatcatcctctgcattcccatcacactctgtaactatctttaatatggtgcagaccacatggcatctgttatttgtgctatgtttgtctctccctttgacttgtgagctctttgagggtaagagctctatcttaatcatctttgcccagtacctccattctacagcgcaaggtctggcacaaccaaggcgctcaatgtttgatgatgaagaataatggatacatttggaaggagataggtgacagacttggcgaagactggagaagttatt

SEQ ID NO: 6571 - DNA, 769 bp, Homo sapiens
  ENST00000520066
acacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccggtaagttttgca

SEQ ID NO: 6572 - DNA, 991 bp, Homo sapiens
  ENST00000518958
ggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcaggaggcccataagaacaaaagcatctcctggggagaggatacactcatggagtatttggagaatcccaagaagcacatccccggaacaaaaatgatcttcgcaggcatgaagaacaaggcagaaagggcagccttgatagctcatctcaaaaaaagctaccaatgaataataacaggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtca

SEQ ID NO: 6573 - DNA, 4651 bp, Homo sapiens
  ENST00000321037
ggagcgccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtca

SEQ ID NO: 6574 - DNA, 3936 bp, Homo sapiens
  ENST00000296741
aaattctgcaagtgaacttgactcaggaaggccagcggctcaaggtccagcccctggaagagagaatagctacagattctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactggccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgagaatcgagagatgcttccgttttggatgaacagcaccggcaggcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgccagcactgccccgcctgtctggcccagccactgtgccctggcactgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttggataattctatacataaaagttcctacttgttaaaaaagatacaaaccttgtttttccagaaggtaggaaaatcctagctttccatttgtgcagttatatgtcattttctcctttcttttcacgttactcaggatgaactctctgagcagggacctgctcctgcagcaaccaaacttggagtggttattgcagacagacgtggctctgggcccctctctgtcccaccttgcacaaaggaccccctcagaccaggcccttgtctgtgccctgtccacacccaggagccatcctcagtgtctgtggccacaatcctgtactgttccttccatccctgataaaaggaggtctacatgaaagcaaaagctactgtctatttctgacccagctcatggaattttttcatcttatactgagctccagaaaggacgtaacttagcatggatcaccaatcaatcaaaaaataaataaatcactaaggattggagaactcatagaacaaggtgaaagacatgagtgccctcccaaagtctgagtgcacgaaaatttctctcttgccttgaggagcagaaaagcttctgatggacatgggcttctgtgagacttatcacacatagtgtatcgtggcatgaagcccggcacatagcaggccctgcatattgatggacaaatggatggcctgcctgccttccctgtccgttcacctgtgcaaaggcttcctcagacatgccactctgtggctcccaatatagggtgcagacaagagcaatccctgacatgacattatagcctgggaaagggctggctcactgatgagaatgtggaggcatcagcaaggatctcggtgggttgctcagagaggtgatgcactaagccttaatcctggacaccagtacccctgcagcatggcttgctcaacaacagtctttgagtggcatagaattccaaagaaaatggtgctgggtggagaatggagagagcatgatggagcagagtcccagtcactgaccaactaactggtcgtttgattaggaaacagtttggccaaagtaccacctttgagacctaagttcttttgatacctttgagaagagccactgagcctgagttgaaatatttttagcttagtcatctgtgtttgctataggagaaattgtaacacaagaaataactcctttttacatgatcatttatatctatatacatatatatacttgcatacactatcactgcattaaaaaatgagtttgggctgggcatggtggctcacacctataatcccaacactttcggaggccaaggagggacaaacgaacccttgaggccaggagttccagactaacttgggcaacacagggcgacccccatctctacaaaacataaaagatttttaaaaaattagccaggcatggtggcacatgcctgtggtctcagctacttgggaggctgaggcaggagaatcatttgagcccaggaggtcaaggctgcagtgagctttgatcacaccactgcactccagcctgggcaacagagcaagaccccatcctccaccccccccaaaaaatagaaagaaaaaaaaagtttgcactaattgaggtacatctgcaagtgagactttttgtcaggaaaaggcaatatatcaggtctcctcaggacgatggaggccttatatggtgtgttaccttgaaaactgaatatcaacgttcaccttgattcaggaaagctgggtgctgtctccatgccatgaatcatgagagcaaaggatcactgcttaaaaatactgaatttaccttcacaaaagatttctaaagatttatgtaatgtgttttaaaagcgccagtaaaccatcggatcaattggaaagaaggcaactcttcagcctttgttatctagctgaaaacaaatgacaactttcaaaacattggcagtagttgttgaaaaagacgtctattgttcaaagtttctttctccttaaaggacggtgttccaatgaattcagtagagcccactttcctccactgtggaggaagaatccctaagagatactcaaatgattaaattaaaattggatcatcaaactcaagagaggcataaacttagacacagtcttgcatttttgtctttcctgaactcttctgccattttcctccttcactcgtcctgaaaatctgcaagttacataataaaactttagatatttgtctgacaaagtgtaattactcaactgaataaatgactgagaacaagttacaaaaggaatcatgaatcctggtaaacaataaagaagattcagacactgagggaaaaaaataaagctttttacttaaataatgca

SEQ ID NO: 6575 - DNA, 461 bp, Homo sapiens
  ENST00000510054
cagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgaggtaattatgaaatatgtgccaatttattctctatgcaaattctataaaacagtccaaagttaaataatagttactcaagt

SEQ ID NO: 6576 - DNA, 852 bp, Homo sapiens
  ENST00000512353
ctaggttagacggttcaagacctggagactggctttgagcaaccctaggattaccttggcttgaattccatccaatacgtctctttcttcatatattggagaggagattaggacccagacgggcacagagggaagaccacatatagacacagggggaaggcggctgcctgcagaccaaggagagaggcctcagaagaaatcaaccctgatgacatcttgatctcaaactcccagcctccagaactgccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaaca

SEQ ID NO: 6577 - DNA, 566 bp, Homo sapiens
  ENST00000505644
agtgatgaggcgctggagtcattgcctggtttcaaagagattgtgagcaggggagtaaaagtggattacttgactccagacttccctagtctctcgtatcccaattattataccctaatgactggtaaaatgatacggagaagaaaaagcttgtgtcgttcaggttccccatttgtgatttgcagcatctacaaaagaccaaccagcaaaaactccacaaaacaaacaaaaacctcggctaacccagactgcctgggcttgggatagctgattttcctaaggacggccttcatctgaaattgccaggactccaaacgcgactgcatgaacctgagcctctatccgtgcgataatagaatgtgcagccctctctctgctcacagagttggattcccagtttctggtttgtttttcagctataacctttgtaaaggcagcgagaggctctcagaaagaatttagcaaactatccagggaggctgctaagaatgcactgttattgctggttatgcgggactcagctatgcactctgagcacagagagagctctgctaattatgttaaca

SEQ ID NO: 6578 - DNA, 2095 bp, Homo sapiens
  ENST00000355097
ccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaa

SEQ ID NO: 6579 - DNA, 1427 bp, Homo sapiens
  ENST00000460614
ctggcttctgccactggttccctccatggtaccacacaagggaagatggaagtgggtctgggcaccgggagtgtgcccaccggagactccaagagaaacgtacgagtcgtcccaggaccggggtggtgagcgaggccccattttgtcctcccagggcctagtctcagacagactggggtgagggaggtggggacaggcggcgagccagcgggcagactcaggcctggagctcgtcctgttcccctggccacacaccaaggtgttgctgcctcctgctccctggtggccatgcctgctgtccctcctcactggccttccaggcatgggcgctggctggggagggatggaagcgtgccctgccgggggtgcccctcggactcggtcttgccattcgtgtccgggcctgtgtggtggtctctggcctcgcacggcccgtgtgtgtctggggaggggtgaagcacgccgccggccccctctccccgtggggccgagacctcctggtggtcgcctgcctgacggtgtcccgcccgcgtcccagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctaga

SEQ ID NO: 6580 - DNA, 1500 bp, Homo sapiens
  ENST00000312665
ctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactc

SEQ ID NO: 6581 - DNA, 868 bp, Homo sapiens
  ENST00000469106
cccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaatacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactt

SEQ ID NO: 6582 - DNA, 3514 bp, Homo sapiens
  ENST00000202028
cagaattgttgggcttcatcttggctctgtgctgcctggaggggagacctaggataggctcctgatctgcaaaatggggataatcccagctgccacttaagtgagacaagtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctga

SEQ ID NO: 6583 - DNA, 210 bp, Homo sapiens
  ENST00000432589
ctttcagatgctatcttgggctcgctgaacacgggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgcc

SEQ ID NO: 6584 - DNA, 652 bp, Homo sapiens
  ENST00000406771
agagcaggagcgagcgcgcgagagagcggggcatttctgcgcagctctagcgcgcctcggagcccgccggggcagccgccggacaccaggaccgcgagccagacagctcccggaagccgcgccgccgccgccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 6585 - DNA, 896 bp, Homo sapiens
  ENST00000430276
cgagagagcggggcatttctgcgcagctctagcgcgcctcggagcccgccggggcagccgccggacaccaggaccgcgagccagacagctcccggaagccgcgccgccgccgccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgcttt

SEQ ID NO: 6586 - DNA, 3631 bp, Homo sapiens
  ENST00000373950
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggt

SEQ ID NO: 6587 - DNA, 3287 bp, Homo sapiens
  ENST00000628415
atttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggctgctgttcgtacctgcctcatggttttcttggggaggatcaatgaggtagaacctgcaaagggcttagcagagagcctagcacctactgagcgctcagtaaagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgaca

SEQ ID NO: 6588 - DNA, 769 bp, Homo sapiens
  ENST00000452261
cgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 6589 - DNA, 896 bp, Homo sapiens
  ENST00000447825
tccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggtagctccttggatattcctttctgcaagtgatcaggcaaagataaattccattttacagatgaggaagctgaggcctgtgaagggaaagtgacctggctacacagccggaacctgaatgcaggacattctgcccctgtcgtggtggtattggagccagctaatgccaccattcgaggttgcaggagcagcacctgaccagaaatccagagcttgtttaaaggaccctgaaatttgaagactatccacacatatctactttctggatatccacggagagaccatgggctttttcatcaaggaggcctgagttcaaatccttcttctatgtctgattctctctgtgaccttgggtgcctgactgacagaagttcttgcccccggggagctggtgtggacagaggaggggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 6590 - DNA, 460 bp, Homo sapiens
  ENST00000427533
tctcctgctggcttctgagagctgacggaacaggttccagcaaggcagaccctgacacagaagccagacctgtccagcagggaccccatacactgggaggcttcctgggaaactggaaggcagaagccacgcagacttctagtcctggttccactgcttactcggctgctgttcgtacctgcctcatggttttcttggggaggatcaatgaggtagaacctgcaaagggcttagcagagagcctagcacctactgagcgctcagtaaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacag

SEQ ID NO: 6591 - DNA, 763 bp, Homo sapiens
  ENST00000373945
tcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatag

SEQ ID NO: 6592 - DNA, 6266 bp, Homo sapiens
  ENST00000338074
catcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 6593 - DNA, 2652 bp, Homo sapiens
  ENST00000373941
ctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 6594 - DNA, 803 bp, Homo sapiens
  ENST00000451082
aacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccag

SEQ ID NO: 6595 - DNA, 593 bp, Homo sapiens
  ENST00000454226
gtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcga

SEQ ID NO: 6596 - DNA, 6665 bp, Homo sapiens
  ENST00000636016
gggatcgagactgggaacgggagcgcaggctgccctcctcccccgcctccccctcccccaagggcacccctgagaaagccaatgagtcccagaggacccaggacatctctcagcgggacttggtacctgagcctggagcagccgcaggcttggaagtgttcactcagaaaagcctcgcagcatctcctgagggttcagagcattgggtatttatagaaagagagtacactaggccagaagagctcggtctcctaaaagtgaccaccatgcagcaggaagaaaggcaggcaggccttgctggtatccttgccaacggcagactctccaaggtagacgttctggtggacaagttcaaagtggaagtggccacagaagaaatggtgggaaacagaagagcaaacacccagcaacaaggaaaaatgattgcaagtcctgaagactttgagtcagtgggggaggaaggcccctggatcagggaaagcccaggaggggctgccctggcttccggccgcacattggcagaaaagctcctcgagggctctgagctcagggcagacaccagagaggcaaccatcaggaaccgctgcatgtcagatggtcagccggagggccagacagagctgaggaaggggctggaggagcctcacacttgtgggagacccactgctccagggaccaggccagcagaggtggacgtcctctctccagcctccgacaagggaggactccagtcgtttctattggatccagcccacgcagaagccagagctgagttgagcaatgaaactgatacttcctttgcagagaggagcttctatttaaattatgaagaaaaagactcagaagaccaagtcctccctccacccctggaggagagaaaagggcgcctggatgcccctcccggaggtgagcccaggccgacgctgaattccttagacctgagggtttctgctgctgcttccagcaggagcaaggacgaagcccacatgacttccccaaaggaaggggcagggacccccaagaaccatggaggacctggtgacctgaagggatctcccgcaggacagacgtttgctgaaggctgggaagatgcccagtggggagtggaaggagagtttccccacctgacagccagcgcagcccgagaggaagggacccccgtgagtggagatttgctgggaaaggctgaggaaagtcccacagaggaactgaagaagcaccctcctcacagaggacagggcgtgcatcccgacccccaggcctgcgcccttcctcgggccatccctctgaatgtcaggaagccagtcaaaccagacagaggcaacttcccacccaaagagaggggagtggttcccacccagaaaggaggggctgagctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcaggcctcctcccatcaccagcagaaagcccagagtagtccctgaagaagctgaggggcgcatacctctggggtttgggttcccttcagggaagcgaagggagatgacctctttccaggctggggaccaagagggctccctagaagatattagcaagacctcagtggccaacaaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactgggaacaaatccggagatgcggtcagggaagagaagcgctccaccaacttagcagccaacacccctgggaagggggggcgcctgagatttgccagcccctcgggccctcagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 6597 - DNA, 846 bp, Homo sapiens
  ENST00000479336
aaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactgggagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccag

SEQ ID NO: 6598 - DNA, 864 bp, Homo sapiens
  ENST00000432603
cctcagtggggagggagttcatagcaaccactccctccatcaccacggagaccatatcgaccaccatgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgc

SEQ ID NO: 6599 - DNA, 5967 bp, Homo sapiens
  ENST00000441639
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 6600 - DNA, 6327 bp, Homo sapiens
  ENST00000373946
gcatttctgcgcagctctagcgcgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 6601 - DNA, 5800 bp, Homo sapiens
  ENST00000374566
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttc

SEQ ID NO: 6602 - DNA, 4006 bp, Homo sapiens
  ENST00000374557
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaa

SEQ ID NO: 6603 - DNA, 5809 bp, Homo sapiens
  ENST00000336596
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 6604 - DNA, 2546 bp, Homo sapiens
  ENST00000452448
cttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 6605 - DNA, 3085 bp, Homo sapiens
  ENST00000494014
agagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaa

SEQ ID NO: 6606 - DNA, 2893 bp, Homo sapiens
  ENST00000469354
gactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaa

SEQ ID NO: 6607 - DNA, 531 bp, Homo sapiens
  ENST00000472696
atgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagatggggtcttgctcttttgcccaggctggtctcaaactcttgggctcaagcagtcttccctccttgggctcccaaagtgctggaattacagggagtagattctgctatcttggcctcacagcccttcctgttgattacaaagcccgtggaagaaaacagaacacaccctcctcagttccgtctaaatgtgtttcttctg

SEQ ID NO: 6608 - DNA, 3454 bp, Homo sapiens
  ENST00000409854
agaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaaggggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagac

SEQ ID NO: 6609 - DNA, 3363 bp, Homo sapiens
  ENST00000409938
acgcgtgctcatcttgtgtaaaagtaaaagttgctcatgtcattagctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaa

SEQ ID NO: 6610 - DNA, 492 bp, Homo sapiens
  ENST00000424339
gcctatcgtaaattcacatcagcaagtgatgtatggagctatggaatcgttatgtgggaagtgatgtcgtacggggagaggccctattgggatatgtccaatcaagatacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatg

SEQ ID NO: 6611 - DNA, 588 bp, Homo sapiens
  ENST00000495693
gaggacaaaataaattaattatcctaaagattatttctgcattgaaacaggcctccccatttatcattttccccttttgcttgagagagcaattatccattcatatgctccctggataccagaggccactttagttaaagaccttgtcaacaagccacccaaaggtttaactatccagatggaatttaaacctactcgtccttttaatatttcattcctagctccccacagctgaggcataagcttggcttgttttaattaaattagatcacacaagacaggtatcttggcagtaaaattgtgcgcagcccatttttatctcattaagtgcagcgctcatcaaaggtttgtgtttttctttctgaaaactctaggtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtc

SEQ ID NO: 6612 - DNA, 584 bp, Homo sapiens
  ENST00000443796
atttattccactgggatagaagcggcaggagcagcgttggcaccggcgaaccatggctgggattttctatttcgccctattttcgtgtctcttcgggatttgcgacgctgtcacaggttccagggtataccccgcgaatgaaggtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaat

SEQ ID NO: 6613 - DNA, 565 bp, Homo sapiens
  ENST00000441679
agtttcatggatctctttctagtactcatttcacttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagt

SEQ ID NO: 6614 - DNA, 579 bp, Homo sapiens
  ENST00000463446
gactatactcaatgaatgcttttggttgcatgacctgcatttcaagccacatgatcgctaatgattagcaagaacgtctcccttcttctgaaacaaggaggtggctttgcatttttgctttggtctatttgcagtggtttctatttgtttgtttttttcttcttccctgcagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacc

SEQ ID NO: 6615 - DNA, 545 bp, Homo sapiens
  ENST00000415749
atttattccactgggatagaagcggcaggagcagcgttggcaccggcgaaccatggctgggattttctatttcgccctattttcgtgtctcttcgggatttgcgacgctgtcacaggttccagggtataccccgcgaatgaagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggat

SEQ ID NO: 6616 - DNA, 552 bp, Homo sapiens
  ENST00000419964
aaaattcaagccagtgatttcctacgggtggaagacgagtctctgattgtcccccaacacatcttgagaaagagagaatactttcgttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttca

SEQ ID NO: 6617 - DNA, 558 bp, Homo sapiens
  ENST00000541600
accggccgggcccgcccccttggcaatgtcttcagcccgctgctctcctaacttaagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctg

SEQ ID NO: 6618 - DNA, 617 bp, Homo sapiens
  ENST00000434266
agctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaaggtttgttaggagtttctccttgaaacgctttccgattccatcttttgaaatccagcaggcgagagtcacgacagactccaggacctcttgagcgctgtccgcagccccacgaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgaga

SEQ ID NO: 6619 - DNA, 6346 bp, Homo sapiens
  ENST00000281821
ctgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgc

SEQ ID NO: 6620 - DNA, 2058 bp, Homo sapiens
  ENST00000470610
ggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatggtaagttccactgctgttctctcaaaacagacccataatttcttttgatgcataaatatccctcatgggcatgtatttattgcaggtgctatgcagtcatatacgttatacactgcagaggtaatgcactggttgttgttcttgttctttcctaaaactcagaaagatatttttatattacttctcagcagtatgaataataagatgaaatgcttccctccactgtttatgtactcatgtattttgtataatcatataacaatatatcttaatgagtaagtccatattacttaccaatagaagtcagaaatcaataaaatgttattaaatgaattgaatttcaattgccccacttatgctgccatcctttttgcatgtcaaataaagcaaatagtaagaatttttaaaa

SEQ ID NO: 6621 - DNA, 3971 bp, Homo sapiens
  ENST00000389672
aagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatggtaaataactcagcatggatgtgtaattttgtataagccgtatatgggaagtgttcacggacttaacctaaaaaaatttatccaggtggggcttccttagtgatgtatgtagagtgtgatggtagatgagaaagaactagttgacctttctttcatgttttgtgatcaagtagcttccaaactgacagaaatgtttcatttttagataattatattcagctctattggttgtattattactttattttttaatactttaactgttggtgcctgatattgttagaattatttgcagaaat

SEQ ID NO: 6622 - DNA, 1078 bp, Homo sapiens
  ENST00000506569
ggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggagcctccaaaggccgctgcttctagttggccatcttggccccaccccgaaacagtaacctttgaagaataaaagaaaaagcaaaagagtagcattactaaaatattaaacggttacatttacagccaaaa

SEQ ID NO: 6623 - DNA, 1413 bp, Homo sapiens
  ENST00000503760
agagtggaacttcccagcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaaagccactggaaatgatgacatatatcctcagggcaaaaggggaagcaggctttctaaagaagtaaatcaaggcacactagccacatttccagtgctcaatagccacatatggctggtggctactgtattggacaacacaaacatagaatattttcatcattgctgaaaattggagtgaacagctttgatcttggtgatatggatgaagacccagagaggggttatgactcctctgtgctgtcgtatagctggctcagaagagaccaactttcctgagctgtgaaaaatgacagttccttaaggaagagatgccacaatagatgaaagacctttttacccatggatccttcccggccattggggtggaggcgttttgccccagcttcctgagggcagggtttttaaatagcatccaggccccgcatccagtgccagggggaggatctttgccccccaggattcctgctgtgcccttcctactatacaccccatgagagcagagatcttgtattgattgacgatatgtctccagaactcagaagagtacttgctacctagcagaccagtaatgattgtggtggaatatatg

SEQ ID NO: 6624 - DNA, 1690 bp, Homo sapiens
  ENST00000477384
agagtggaacttcccagcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtgtcaaatcatgaatcattttgatgttaattaaaatgaaacagcccacaatcaaaataacgttgcaatatgtagtacaggaaaaaagaatgcagcttaacagcctccaaataggaaatgcaatagaattgagtagtgttaaaaaggacagaagtcactgtatggataaccagacccaatattgactacagtgtaatcaatcacaagaatgccagagtcccctggtgaagttccggaatatcctttgtttgtcacagttggtgactggctagattctataaagatggggcaatacaagaataacttcgtggcagca

SEQ ID NO: 6625 - DNA, 1682 bp, Homo sapiens
  ENST00000514100
cagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactagacccacaaatcacaacaaagagcaatcagaactggttaaagaagatggtctggaaagcttgtgtgagcagtgcgagtccagctctggttatggtactggactggtcctcatgtggaagagaaacagaagggccatgggagccagtggccagaccagaaagcaatgtgacaagagagataaccctccaacagacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaa

SEQ ID NO: 6626 - DNA, 1189 bp, Homo sapiens
  ENST00000508345
acaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggctgtatcctaaagcagaatataatggcaaacagtgtagcagatattcaatctaaattgctgctaaaaatggatcaaatgactaccacaagcaaataagaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccaga

SEQ ID NO: 6627 - DNA, 1582 bp, Homo sapiens
  ENST00000502694
acaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaagtga

SEQ ID NO: 6628 - DNA, 681 bp, Homo sapiens
  ENST00000506349
ttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatgcaacagctttaaaacctatctcagcccatgaatggaaaacaaatccaaatccgatccttgaaaagcaaaggctctaaagaagctcttcagaagagacggtaaagaatgaattcttttacttatcacccaaccacatttcttaaaaatgtgttttggtgtcttttcctaccaaatttctgctctacaaggcagtcagttaaatctctcatttcataattttcactgtgctagttctttcttttctcctcttttaataaattttctaaaacttt

SEQ ID NO: 6629 - DNA, 487 bp, Homo sapiens
  ENST00000467013
gtattgcctccagcacactgtttacattcctactgtgtctcagcatctgttctcctgggaatagaactggtccacctgaacatatgatctgtgctgctgttggtgcaggaggacaggagggaaataagctggaagccatggatgtggagagtctggcttcaagatggagcttgtttacctgcaggttgtcccccaggatgccctcacagcttgtgcgtgacaaagatgtcctccgtgtacacataaggtagcgctgagaagccacgagaaagcacctagtgattttaacataaacatttccacagcattttcaagttctgcgaaaaagcccggtgatagatcagcctcgcggtgtgcagcgccggcagctccgcacttcggacacctgggggcgcccgtgccattccgccggcgactgggactcgtcgcccgggaaacaaagatggggatttaaagaaaagccttcaaaatgcaactccgaatgtct

SEQ ID NO: 6630 - DNA, 581 bp, Homo sapiens
  ENST00000472904
acattcctactgtgtctcagcatctgttctcctgggaatagaactggtccacctgaacatatgatctgtgctgctgttggtgcaggaggacaggagggaaataagctggaagccatggatgtggagagtctggcttcaagatggagcttgtttacctgcagggccccatgcagaacctcatgagacgtgacttcagaggcctcctctctgaaggtgagggaggcgtcagctgttcagagagagaggctgccttgcctggggacacacagctagccagtggccggagcagcagtggatgcagttgtcctgatgcatagttcaagaagctttttttttttttttttttttcacgtgtgaaaacatctattgggaaaatggaaaaatcatttgacctcatattcctcatagctgacatgtctccttgttcccaccccactgaccactgaattgctgcttgaattgccaggaacttcctggtgtggcagaaggaagactaagaaccaggaagtggctgacaagaaagggagctgcattctgcaactggagttagtatttgctctgacctaacactttgggtgatt

SEQ ID NO: 6631 - DNA, 569 bp, Homo sapiens
  ENST00000467708
aacatatgatctgtgctgctgttggtgcaggaggacaggagggaaataagctggaagccatggatgtggagagtctggcttcaagatggagcttgtttacctgcagggccccatgcagaacctcatgagacgtgacttcagaggcctcctctctgaaggtgagggaggcgtcagctgttcagagagagaggctgccttgcctggggacacacagctagccagtggccggagcagcagtggatgcagttgtcctgatgcatagttcaagaagctttttttttttttttttttttcacgtgtgaaaacatctattgggaaaatggaaaaatcatttgacctcatattcctcatagctgacatgcctggctcctttctgtggagaagatcctgagaggaaccacaacttgacaaaaccaaaatgtggtggtgagccaacttcaattttgcagaaactgacttggaaagaactgattacctgaaggaccgtgaggatcaaagttgtcccactgaccaggctgtaaactttggaactgataagtgagagagataaggtaaacttctttaccttt

SEQ ID NO: 6632 - DNA, 564 bp, Homo sapiens
  ENST00000460895
ttttttcacgtgtgaaaacatctattgggaaaatggaaaaatcatttgacctcatattcctcatagctgacatgacaaaaccaaaatgtggtggtgagccaacttcaattttgcagaaactgacttggaaagaactgattacctgaaggaccgtgaggatcaaagttgtcccactgaccaggctgtaaactttggaactgataagtgagagagataagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacct

SEQ ID NO: 6633 - DNA, 1496 bp, Homo sapiens
  ENST00000482618
tctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggtgtccaggcctttttggaggatccttagacagcaggattgacattggaggagcctggtatttctgccacactcacacagcctcctctgcatccaccccctctgaggaagcagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatc

SEQ ID NO: 6634 - DNA, 4672 bp, Homo sapiens
  ENST00000398015
tctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccattctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaa

SEQ ID NO: 6635 - DNA, 729 bp, Homo sapiens
  ENST00000488154
atggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtga

SEQ ID NO: 6636 - DNA, 389 bp, Homo sapiens
  ENST00000497173
cttttctccagctcgcagtccacgggctagtggactctgcttggcgtgcaagcactgcgcgcgggggccggagaagctctgccgtggtatcccgcaagtggccgccgaaggagaggggtggagttcattggccgtacccttggggaccagtctggtggtccgggcgcctgcgggactgcaggtttccagggtcagtcggggagaggtggaaacccttttcgcctcttgagccttggaacaggagtgggctgggaaacgttaatggacaccagaacggctactgcagagctgggctggacggccaatcctgcgtccgggtgggaagaagtcagtggctacgatgaaaacctgaacaccatccgcacctaccaggtgtgcaatgtcttcga

SEQ ID NO: 6637 - DNA, 511 bp, Homo sapiens
  ENST00000473867
agatgcctgcaacagcagaatgagaagaaagcagggaaatgctctgtatcggccaaataaaatcaatctggctctcagatgcattggaaacttcaaattaaagcaggacaaatagcctaaggaggcttcacaaggatggaggcagtaggatgagagattcctgaaaggaggcagggatgactacatcataaaaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaa

SEQ ID NO: 6638 - DNA, 554 bp, Homo sapiens
  ENST00000474732
gatttttgtaggtgcatccaactgcaacagaatacatcagcctcatcggaaggagaatggaaggcctgagaacgcacaaaaggagcatttggagaggaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatgg

SEQ ID NO: 6639 - DNA, 2786 bp, Homo sapiens
  ENST00000493838
actcccaccatccccctctaacagcacggagtcagtttccaggcagtgggcaaggagggctaagaacttgccccaggctacctgcctcccagctgaaaagggctttagttcttcccctgcctgtggagtctgcatgccagattcgcaccctcccctgagttctggccaggaggcttctgaacaagttcatattgttacaaagttcagctggagacttccttctccctgtggcattttcccagtgcctctggctgccctcctgagggatccctgtggtgccaggcaggaatttcctgcttggggaacccagtgggctcccagagcctttctcgcagcttcctctacccctgtatttcgctcggctctctaaattgactcagctccagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaa

SEQ ID NO: 6640 - DNA, 509 bp, Homo sapiens
  ENST00000488992
agacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggtgagccagctctacctgcaagcttgcaagacccaaggccagccactgttccatggatggttgctagctgaaggcacaaaggagataggctgctgaggtggggaggattctggtgacagaggccag

SEQ ID NO: 6641 - DNA, 3789 bp, Homo sapiens
  ENST00000360620
cgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 6642 - DNA, 4329 bp, Homo sapiens
  ENST00000358173
cccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 6643 - DNA, 5058 bp, Homo sapiens
  ENST00000487222
atgcgaactgacagatcaaagcgtggctgcagctgagctgggacgcagaaagggagcctgcgcttgctctgggctgcggacagcccgaggcagagacagtgtgtaaattggagacaggaaaacactatcccggctggaacaatggagggtggagacggcagcctctatccacccccttcccagaacccgggcatcctgtccccagtgagcagggctgtctcttgccacccatggggaccttgcgcctctcacctcaggctggctggcttcccatctgacccctagctggaggacatcatttggtccccaggaagaggctgcctcacccaccctctttctcttctctcctgcagctcccatggggtgggagccaggtgttctggctcccctctccacccttcccagcgcccaatgccccccacattgccggcccccgaggggattcctgtaccctccctcctccactctccactgccaggggctgtgcagtttttcctaatccccccccttcctccagtgcctgtcccctcccccgatgatccgagccaagccaggtgtgttcacccctcccattcataccgccccccagaatctcctcccctctgccttcccataaccaaatccagatgtgaggcctcggcgggagcctgggaaccctagcatcccgacctccagtgcttcctgatcagggcactcgtggggagggaggtactgggatgggggccagggctatgccccaggcacggagcgctcccttcaaggagggaaggacggggtgtttggtctgaaagcagagaggggtcttggacagggaatgaaattgtggggtagagaggctgattctgggacttaggggaggaaacgtggaggctgagacaagaggttcccctcccacaccagcagcctctgctcgtgggggtcaggaccagggcgcagctctcattttaaccctttctgagctgccgccccttctccccgtacattttgatctccctccctcctccagggaggcctagatctggggtatcccaagggagccccatgcctaccagatgttgggggtggggttggcacttagcagaagaggccagaaatcaggcgggtgcagagggcagggcttgctcccctcttggccccccaactcctctagctcagagctaagaggatccacctgcctcggttcccagggatctggtcttcctgacctccctcccccaccccaggcactgactctgtctctctgtctgtctcagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccagg

SEQ ID NO: 6644 - DNA, 812 bp, Homo sapiens
  ENST00000492403
taaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtaagtgtcccgtggtcctaccaagctttcctcgagtgttctctcacctgggatttggggtgaagggtgggttcccagagagtcatcactgctgggttcttgagaccatggagatgacaaaaaggagaattgatctttgtatcaaagagttgagatacagggccaggcctagtggctcaagcctgtaatcccagcactttgggaggccaaggtgggcagatcacctaaggttaggagttcaagaccagcctggccaacatggtgaaaccccgtctctaaaaaaatacaaaaaattagcccagcatgatgggcgggtgcctgtaatcccagctactcaggaggctgagacaggataatcgcttgaacccaggaacagaggttgcagtgagctgagatcacgccattgctttccagcctgggcaactgagcgagactctgtcttaataa

SEQ ID NO: 6645 - DNA, 965 bp, Homo sapiens
  ENST00000478459
aaagccggggctggggcctcctacaggaccatcagtttctcctgatcagcagcctttccttccgcagagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgt

SEQ ID NO: 6646 - DNA, 709 bp, Homo sapiens
  ENST00000467515
ccatctcaggaaaaaaaaaaaaaaaaaaaaaaaccacggagacaggggtttggggctaaaagctatgagccgagcctccgagtccagtgggagttaattcccagctgacggggccctgcctgatttctcaggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctg

SEQ ID NO: 6647 - DNA, 1551 bp, Homo sapiens
  ENST00000477446
atggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcagagagcgagggctggcgggagcagctggccctga

SEQ ID NO: 6648 - DNA, 921 bp, Homo sapiens
  ENST00000489808
atggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagggcgccgagggtcccagcagcgtgcggttcctgaagacgtcagaaaaccgggcagagctgcgggggctgaagcggggagccagctacctggtgcaggtacgggcgcgctctga

SEQ ID NO: 6649 - DNA, 769 bp, Homo sapiens
  ENST00000492878
tttttttttttttttttggagatgggatctcgatatgttgcccaggctggtcttgaaccccttggctcaagcgatcctccagcctcagcctcccaaagtgctgggattcgaggcatgagccaccgagcccaccgtgcagatggatgtttttgtgcatgcttttgatgaatgctttctctctctcagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgt

SEQ ID NO: 6650 - DNA, 3737 bp, Homo sapiens
  ENST00000616502
ttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 6651 - DNA, 16219 bp, Homo sapiens
  ENST00000270460
ctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcactcccagattcccatctgtgatttcgtgtgtcccccagagccccttcatccagggacccagggctcaggtcacatctctttctcgggggtggctggcaaccagcccctctgtctcagaagccctgatttccctgaccctcccaggtcaagggatggctgggttgagggtggactgtgcgaggcctggcggagctgtagcccacacaggtccaggtggtcgggaggccactcatggccagacgcttccggtgcaggaggccttgctcttgtgttgaggggacaccaggatgaggtcagagagtgcactggggttcagggaggagaagaatcctgagagatggcacatgtgcaacacaggtcaccgtcgccatcgcccgggcccaccgcaagcatcactaatccatccctgcactcctggaaagccgggtcagcctctgccggctgagctgagtggaccaccaggcgcctcctggttgtcctctgtgtgctgttttcctctgtgtgctcttgtcctgggctggaccacacctggtgagactatccgggagaatcctcgggccgccttgtgaggggggtgttgctgtcatctccagggctaggtgacagcttgttgcaggccccacagccagggcctcagggatggggatctggccatgtctgttttaagccgaacaggctgttcttccatgtggagtctccctccgtgatcccctggggtcaagtcctgacggctgggttcgctccctcagtgactccgacagctcttgtctcagaggtgctggggtgaaggctgtgtggggccaggcccctggggtcagacttcttgccccttctgcccgggggacgctctgggctcagggtggggccagacagctacatcacagggacacttgttatgggtcggggtccagggagcacccagccagtggagtgttggaggccactgagagggacatgactgcggtgtccgagcagcgtcgtggccaccctgtgtgcccactccctggtggacagacctacgtcacctggggattgcagagcaaaaggagtgctgttggggtgatgtgaggttggggttctgtttcttgctgtgaattgggtcatgacctgtgtcggagcgttctctggcctccacttgcccctgcagaccagggtgtctggagggttgtcgggggcttgatggaggaattgctgaccacaccatgcaggaagaggtgggtcccagggacacaggaactttggggtcagccggttccagattcagttgcagaggagcatcccccttgcttagccagggaggggaagccctcttctcacacccggcctgggtatgttgtgggagagtcatttcccaggaggaaatggggactgttaccgggggagggggtgctgtccccaggcagcagcaagcgtcccttacgcttgggctgtccgagaccctgctgctctaggcggttgtgatgggggagccccacagggcacagagagccagctgaaggcggcagctctgggtgggatcacatggaaaggggaggcgagccgagcctccctcttgccaatcttggtctccccacagggtcatagctcctgggcccctcacttgtcagaccctccattcaccaaattaaggataagtttcacgatttcgcactgcggagcctgcactccctttctcttcaaaaaagctgaggacgaagataaaatgatacagttggattagtccagtggaggggttaaaggtgtgaggctttaattctccccaccatttcctcatttggcaaaacagagaagacaggattgaaaaacaagacaaaaacccagaggcttgcacataaatttggggcttaactacagcatcttcggcatcttcttttccctacagtgcgaattacaaagtagcaccacagatctcgtgtctcctactttattcctctttctagaatattccagccaccaaagtgctcagcaggagctgctgtgtaggagtcccccatgaggcccaagcacctgagcttagtgacatacacggttgaacgctgggagaatgctgggagcctgctgttgtccccgattgagggctccccccactgtgtgtgtatcactctttctacagcagatgtgtctctctccccacagtgggatggcgagcttgttaaatggccgtgaggaagactttattcaggaccatcgagacaggtacaggtaccatcagtggatggaaaatcactaagagcaaacctcaggggtccgggggttttcggctaaacccacctagcaggattcttgctgaaggcaggccagggtgatcagaggtcacctggggatggtggaggctgaagaagcctatcagatgtgagggtggcgggggttgggggggatggcggcggggttcatttgctgaaaggattttacaagggcatgcacggatgggcctaggaggaggttcagatccctcaggtttggctaagcaagagtcatggtggtgctcccggctggctctcaggagcagatgtgcttctgacccgacgtcttcccccagagagggctgaagtggaaaaaaccccagaatttctccctgggacaggtgaagcgatggggcgtgggacattcctgggtctcgactctgttcagggcctaggggttgggtggggaaggcacttgagggaaccttcctggagcccgtaggagcttcatccgagctcctgggtcaccccgcccaccagagtccaggcccaccagagtcccctgccacctgtgctcaccctagccttacccctcgctctactcccgccctcgccctatcctcgctcctcgccctacgcttgcccctcgctctggagctgcgatgccagcctcagggctttcagtcctgccttgatctttttttatactgaaactcaattttacacacacaaacccactcccagccagcctctgccttttgccttttcctcatgttctcattgaataggaagaaatgcccttttttttcccccctagaaggagtcttgctctgttgccaggctggagtgcagtggcacgatctcggctcaccgcaacctccacctcccgggttcaagcgattctcctgcctcagcctctcgagtagctgggattacaggtgcccaccaccacgcccagctaatttttttttgtatttttagtacagacggggtttcaccatgttaggatggtctcgatctcctgacctcgtgatccgcctgcctcggcctcccaaagtgctgggattacaggcgtgagccactgtagcggcccccaccccatttcattttttatttttttattatactttaagttctagggtacctatgcacaacgcgcaggtttgttacatatatatacatgtgccatgttggtgtgctgcacgcattaactcgtcatttacattaggtatatctcctaatgccttccctcccgcctcccccaggcccttagtttgtgctgctctgcgttggttttctgcgtgtgctaaaaggggagggagagtttctgtgcccattcccaggcaccttcttgcagccgcaggcatctcccccacacgtgcttctagcttcccgggtgtggcgtgagccattgcgtccggccagaaatgttttatttcttgagaacttgtctgtctctgtgatgactgtgggttgtccagctcatccctcaagcgccatcctgccaggcccttcactgtggtgagaaaccggcctactcacatcacaggtgcccctggagtttctcaaactgcagcccaaggattggctgcttgcttttgtaaaaaaaaatgttttattagagtgcagccacggctgcttctgcactacagtggcaatggtgacattgagtgtggcagagaccgagtgtcccttgagcctaaaatatttactatctggctcttcaacaaaaagtgtgctgacccccggtgattgcttgtatgtggcaggggtctaaggcctgcctgcacgtcctgggacagcccacgcttccacagggttccagcatgctttccgccgagaaatcgctccctttgctgtttgttttgtattgaatgtttcttcatgcttttgttttactttcagggataattatataatgttatgtttcatccacattattttagtatggatatttataatttcctaaagcactattttttttttttgagacagagtcttgctctgtcgcccaggctggagtgcagtggctcgatctctgctcactgcaagctccgcctcctgtgttcacgccattctcctgcctcagcctcccaagtagctgggactacagatgcccaccaccatgcccagctaatttttttgtatttttttagtagagacggggtttcactgtgttagccaggatggtcacgatctcctgacctcgtgatctgcccacctcggccttccaaagtgttgggattacaggcttgagccactgtgcccggcccataaagcactatttaatgactgctccataaatacaaacttcctttccttattattattatttattttttttttgagatggagtcttgctctcgtcccccaggctggagtgcagtggcgcgatctcggctcactgcaacctccgcctcccgggttcaagcgattctcctgacttgggactacaggtgcgtgcgaccacagccaactcatttttctgtttttagcagagacagggtttcaccatattggccaggctggtcgaactcctgaccttgtgatccacccgcctcggcctcccaaagtgctgggattacaggcgtgagccacggcacccggcccataattacaaactttctgagggacatcttgaagcacacaaaactatagacaatattatcataaccacccctgcaaatgcctcactcgtgttcagccatcatttacatttgaaccactcctgtttcacctacagcctcctcatggcccctcccctggagcacttaaaaatggtaatgacatgctctctagtaatcgttgtgtgttactgtcaaaaggtataactcatgcattgatgggggtaacccctacagcagttaaccctgcgtgctcagaggggaatgaaaggtagctcagaggctcgggaggtgaggttgcaaaatggcttgtgttgtggggaatgttctcatccacccaaatcaagcatcactacatccatccgcaggggaggcaagcttagggcatcacgtccaggagtggccaggtcccgatgtcacggggagccgggctgggacaagctccagacggccagggtggtgtgggtttgcagtgggagggctggcgcgggggccctgagggctccctggttcccatcttatcaagatgctggactcggtgcttgaaacatgtcctgacagccacatgaaaagggttagaaatgatactgtttcgcctgggtgctgtggctcatgcttgtaatcctagcactttgggaggccgaggcgggcggatcacgaggtcaggagttcgagaccagcctggccaacatggcgaaaccccgtctctactaaaaatacaaaaattagcctagtgtggtggcgggcacctgtaatcccagctacttaggaggctgaggcaggagaatcgcttgaacccaggaggcggaggttgtagtgagccgagattgcactactgcactccagcctgggtgacagagtgagaccctgtctccaaaaaaaaaaaaaaaatgatactgtttcctgtatttttttctcttagtatcttaagaaatacatgatttgaacaaggaccttgtgtctcctctcccctttcccggactattctgaccccagcagttctcagaaggagctgacattaatgagaacttctccctgttagacccttaaaatactgagctttcgggaccctgcctggcttgttcctgtaaaacggtcttgtctgtggtaaatactaaggtttttggtctcacagccgaggaaatcaaggatgtggatgcacacagagtgagatttggagcaggagtttaataggcaaaaggaagaaacagctctgtcacagagacgggtcccgaacgggttgtgaagttgtagaagaaatgtcaggggttttatagatgggctagtgaggaggggtgtcttttcttcctagggcctgaagaaccagttaggaccaggtgtgctgtctgcatcgagcagagtctctagcagcccccaccccattcttttttttttttttttttttgagatggagtctcgctctgtcgcccaggctggagtgcagtggtgtcatcttggctcactgcaacctccgcctcccaggttcaagcaattctcgtgcctcagcctcccgcgtagtcgggattacaggtgcatgcagccatgcccggctaattttgtatttttagtagagacaaggtttcaccatgttggtcaggctggtctccaactcctgacctcaagtgatccgcctgcctcggcctcccaaagtagtgggattgcaggcgtgagccaccgcgccgggcccccaccccattctttgatcctgcaggcaggcccttcgtttgtgctgctctgcgctgctgcttatctgtgtgtgctaaaaggggagggagtgtttctgtgcccattcccaggcaccttcgtgcagctgcaggcatctcccccacgcgcttccagcttcccttagtgtgcctaaagaaagggaaaggaatgtgctttaggcccactgttttcactggggcccatctatgtatgtggcttggtgattacccaggaacctcccaagtctgtgcccgagttgcttatctgtgttttacagcctgaaagatcaggctgctctttgttaggagaagtgatttctttgaactgcgtggtgtggtgagaaagggagcaatttctaagctgctttttgttaggaagttttttgctggggactctcttcgccctatctacctaaatgatttctgtttcttacatcaattgggtattgatttcaggtagaatgggtgaatgcatttattcgttcatctaagccgcatttactcctttcttttctttcactgttgttttttttttgagacggagtcttgcactgtcacccaggctggagtgcagtggtgcgatctcggctcactgcaagctccacctcccgggttcatgccattctcctgcctcagcctcccgagtagctgggactacaggcgcccaccaccacgcccggctaagctaattttttgtattgttagtagagacggggtttcaccgtgttagccaggatggtctcaatctgaccttgtgattccgcccacctcggcctcccaaagtgctgggattacagccgtgagccaccgcacctggcctctttcagttttgatagcagattatttcctttggccctgcgtggtctctctctggctgggcagctctgggccagccataaatggaggggagggcgtgtgtgtggccacgtgtgtttctgtcctggacaacactgtccggaggggcctaagtgggaagtgccctcaaccaaggagatagctgctgtgtgtgtgtgtgttgtgtgtggttgggacagtcggggattctcacttttttttaaaatttgagatggagtttcactgtcgtcacccaggctagagtgcaatggtgtgatttcggctcactgcaacctctgcctcccgggtttaagcgattctcctgcttcagcctctcaagtagctgggattacaggtgcccgccaccacgcccagctaatttttgtatttttagtagagacggggtttcaccacgttggccaggctggtctggaactcctgacctcaggtgatccacctgcctcggccccccaaagtactgggattacaggcgtgagccactgggcgcagcctgggatcctcactttttcgcagattggtcactagcagggcgtctgatggaactttctgagatgccggaaatgttctctgtgctgtacaaaagggatgccactagccacatgccacgtagaacagttgaaatgtggccagcatgagatttttttaatcttgccaatttttgatggatttaagtttaagcacctgcgtgtgagcggctaccgcgtgggctgggattggaggaagctggaaagcgctcccctgcgtttcggctgctggcccagcagagggcgccggagagcggacggagccgcaggcggggttgtgggaagacgctgggatcccgtgcgcgcttgtgctccttccttctgggccagcgcgcagactatcaaccgaggtattcagtccctcggaaacccagttcctccgtttccaggcttctcgcccacacggagacagtcgctctcacacgtacctctcgcgggctcttactcgtggtcccggtctcctcctggtccccaccttccagcccagcgcgcacactagacggcacgtgctctccacgctctttctccagcgccccttgctcacccgccccccgttggagtggcccatcctctccgcttagacacctgcagtcactgtcactagctgaactgcgccctcctgaaagctctatgttgaaaccctaccccccaccctgcaccgaccccgtaccccagaatggggctgtatttggagacagggcctttacaaggtaagtaaggttaaaatgaggacattagggtgggtcctaatccaatctgactgttatatagtggggttgcaccttcatgtgaggacgccgggagaagacagccgtctgggagccaaggagagaggccttggcggaagccaaccctgcagcaccttcatcttgaatttctggtttccagaactgtgagaaaatccattgacgttctatagcgctcccagctggcggtactttgttatgacagccctaacatgaatgcagccatccacactgtctgggggaaggcacacacaccccacagcacccttgctgtctcaccccgtatcgcaaaagctcacgcatgtgtctctcccgagtccctggagggtcctgccacctacatctctctccttggcctgccgcctgtgatgctcctgggccccctgctccagcaccgctcccttccttctgtaatacagacaacagagacaggagatggcctggccccacttcatttctgttccctgggaaataagcatcgcaagtgatccgtagaatggtagacatcatccacttcccaagcatctctggctgaatgctgttctcatccacttcccaagcatctctggctgaatgctgttctacacatgcacgtgggaggcaccagggagcccagaagaaatgaaaagcctgggcagactcgcagttctgccacacagtgaatgtgctactcaagccactcagcctgggctgcagaggttggaagcctcactggcctgaggtttctgagtaagctctgacccaatcattgactattaaacttcagaggtccatggagacctcttaggagtctttgaaggaacttagcatagataccgatagctgctgactgcagggagatggggagatatgttttgtaaacctgtccaggcaacttttttgcctacggaaacacacaaaaacgaaaacaaaccaatgaaaaaaacctctcagaacgatacagaatccagagccactacaacacatttcatgaagtggcgtgagcctgtaattccagcagtttgggaggccggggcgaatggatgacttgaggtcaggagttcgagaccagcctggccaacatgacaaaatcaccatctctactaaaaatacaaaaattagtcatgcatagtggcatgcacctgtagtcccagctactcgggatgctgagatgggagaatcgtttgagcccgggaggtggaggttgcagtgagccgagatcgcaccattgcactccagcatggacaacagagcaagaccctttcttagaaaaaagaaaagtatccccgaacattatcagagtcaagttaataaaggccaaaggtagagaaaatcttgaaagtatcgagaaaatgacatgtcaatcataaggtcaggttcttcaacagtcatactgacattgtggctggaatatttgttgttgtgggatatatatatatatatatatttagagtgttgtgggatatatatatatatttagagacaaggtcttgctctatcactaaagctgcattgcagtgtgtgatcatagctcaccatgggattcttgattttcagtgagtataaagtgtaagacaaaataagtcttagttcaggtatgctggatgggaagccagaggtctgcatagcagttacaaagaaggccttattatctggaagaaaagggaccatagaatgtccattggttggggaacaacccagctttagtttttccagattctctgcatgtgcaggtttatgagactggagaactttgatttcttcttcctcctcctcctctcttttcttcttcctcttcctcctttttctcctcctttcttcctttatttttctttcttcctttcctcctctttcttctcctttttcctcctcttttcttcctttcttctctttttcttcttcttttttttttttttttaaaagaccgtgtttcgctctgtcacccaggctggaatgcagtggcgtactgttttagaaaagtgaaagagggccgggcgtggtggctcatgtctgaaatcctagcactttgggaggctgaggcgggtggatcacctgaggttgggagttcgagaccagcctggccgacatggcaaaaccctgtctctactaaaaatacaaaaattagccgggcatgatggcagatgcctgtaatctcagctcctcagtaggctaaggcgggagaatcgcttgaacccagaggcagaggctgcagtgagccaagattgcagcattgcaggaaagagagaaaaaggagggaaggggaaggaaaaggaaagaaagaaaagaggggaagggaagggagagatttaaaaaacaatagtaaagagagatttaaaaaacaatagtaaagagagattaaaaaaaaaaagtaaatgggccaggtgcgatggcttgtgcctgtaatcccagcagtttgagaggctgaagtgggaggatcacttgaagccaggagtaccagaccagcctgggaaacatagtgagaccccgtctatactaaaaaatatttaaatgggctgagcgcggtggctcaggcctgtaatcccagcactttgggaggccgaggcaggcggattacctcaggtcaggagtttgagaccagcctgaccaacatggcaaaaccccatctctactaaaaataccaaaacaaaaactagcagggcatggtggcgcatgcctgaaatcccagctactcaggtggctgagacaggagaatcacttgaacccaggagacggaggctgcagtgagccgagattgtgccactgcactccagcctgggcgagcaacagagtgaggctgtctctcaaaaaaaaaaaaaaaggaacggtagtgtgcacctgtggtcccagctacacaggaggctgaggcaggagcatcacttgaacccaggagttcaaggctgcagtgagctatgatggcaccactgccctccagactgagccaaaaagcagaccctgactctaaaacaaaagaaagaacaaataacaaatgaaaataaatacccaaaaaccagtcaaatgtgaaactggtgtcaggggtatgttctccatgttgagccccttctgtggaatatgacagtgtctctatttcgggtaaaggaaagaccaaaataactttccaagatgaaaagctaagagtgctgatctcatcacagacatagccagctcttcagttcagaccacctggaaaccctccccatgtcttttcagaacaatgtcctaagaaccataggggaagtggccataaaaaccatctttcctttgcagactggggtggggactctggccaatgccattctgttcttccataatatctttcccatcttgactgagcatcaaatgaggcccacacacaagattctcacccacatggccgtggcaaactccttggttcttctttccactggaatcccccacacaatggtgtcttttgtcctatggaaacccttgtccagtcttgagtgtaaactcgtgtttacaggtcttaaagtcctgacctggtgatccgcccgcgtggacctcccaaagtgctggaattacaggcgtgagccaccactcctggcctatgccagcattctttaaagttgtgggaaaaggccaaaagcaaatagaaaattgggcaaaaaagttcataattgcttaaacatatggaaaacctggaagtaaaattaagcaagtaagtgcgagcactctacattgaagattatagaaaattcagcctcccaaatatccaaagaatccaggagtgtgccaagagatccaagagtaggtccacaatttctcattctcaggagaatctgagattatatttcaatctaatgataactgattatataatccaatttctgcatcatcttgcttttatgttttgtaataaaaattttagaccaggccaataaggcatcagcaatttaccgtagggaactagggaatgtttaattatgacaatgaagtgtttaatattgtgttttgaaatataaacagtgtagatatatttgaataatactgaatttttagaaaaatctattggggtgtcatatataaaaggataagtagagatttggaaatgcttttttattggacaagaaaattgatcaaatcgaaatctggacaaactagaaagtctggatgctagcaatacaatctatagacacattctagcatcacttctgtgtcagaagtatccggattgtggtgcctacaaatgcatgctcctacacaccaagacatccattaagaaaataaagccatgctttccagagcgtttagcacttgtttaacgtacttgtgcttctaaatatcacaaggcaggatgggatttctaaagacaaggggatataggaccgaggcaaagacaatcagcatgtacactgaatcacactccataatcatattgctagaacacttagggagtacctctgaaatcacagccctgctgccatgatgtgcaattacaggatagaggtgccaggtgaaggtcccactgtggccaaggaaagcctttgtgagacgactacttcagggtgttccccatcagaggagcacacccctgatcttgtattcctcgtcaatccaaggtccatgtgaaatggtcagatggggaattttttcttccacagacatcaggatcttctgagtttcttcatcaaagccagatttgtgcagcctgggaaaatagaaataaagtttttttttttgtttttcatttttacacagtattgcctctctacattctgatgtctacctctcctctcctctttattctttcctagaaatcactgggagaattgtactgaatttgaaaaacaagcatgaatctttcctataggataggaagcctctgatttataccataaagtgaaatttcatatacaggatgtatcaattaagatttaattcaaaaaagatgaatttaagttaaaaagaaaaacacaggataacttccattcatctgatgttcatatgccctggcacatctattgcttcttataatgtgcttgcttaaaaaaaaaaaacatgagcttttctcagagacactaatataatgaattcatgtacccatcaccaacttctacaattaccaatattcagcctcttccatttacaacctgcccattttctaagaaataattaaagcacatgctacacccataaa

SEQ ID NO: 6652 - DNA, 2355 bp, Homo sapiens
  ENST00000085079
cggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggc

SEQ ID NO: 6653 - DNA, 2621 bp, Homo sapiens
  ENST00000411543
aattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggagcccagtctttgcatgcagtgttgaaaaaggtaatgtccctcttgtgctgagcgagcacctggcacacagcagggacccaggcagtggggctgttaggttccttatctctcctgagccttgggcttccgctatccttgggacgtctggtcttctggcttccccggttcttcctgccgccctggatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgg

SEQ ID NO: 6654 - DNA, 593 bp, Homo sapiens
  ENST00000591743
agggcaggggtccaggagggggtccctgggtccacgtctagccagcgcctcccttcctggctgaccacttctatcccgcagtccccttctggaagccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcg

SEQ ID NO: 6655 - DNA, 583 bp, Homo sapiens
  ENST00000586194
aggttgccagcccctcatgctcttctgtcctcacccaggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggtgagcccctgccctcccctgcccagtggcgagagggagcctcccctagctcttcgggagccccgtcccttgctgtctttgtcccactccaggcagggccggctggacttagggatgaaaagttcagttgggtagagtgggccagaaccatccacctgtctttaaaagaagtgtgcatctttattttagagaaattgcagacttagagaaaaactgagaattgttctcaaggtttcccacccgaatgttgacctctgacccgtctctgcctccacgttgcttgagtgccttgcaaactctccaggtgtctcaaagaacacggactgtcttgtcctgtgcagtgagctgcg

SEQ ID NO: 6656 - DNA, 250 bp, Homo sapiens
  ENST00000589704
ccaagcccagcaccaatggcacaacagcagccgggggattcgacacggagcccgacgagttctctgactttgaccgactccgcacggcactgccgacctccgggagcagcgcagcttactggacacgacttcctcctggcttctactccctcaacagctatcgttcttgctttatacgttgaatctctgtctctttataacttctaaatgttctcagcatcaggaaaatataaaaaataagttcacaaat

SEQ ID NO: 6657 - DNA, 537 bp, Homo sapiens
  ENST00000587937
aagccctgatttccctgaccctcccaggtcaagggatggctgggttgagggtggactgtgcgaggcctggcggagctgtagcccacacaggtccaggtggtcgggaggccactcatggccagacgcttccggtgcaggaggccttgctcttgtgttgaggggacaccaggatgaggtcagagagtgcactggggttcagggaggagaagaatcctgagagatggcacatgtgcaacacaggtcaccgtcgccatcgcccgggcccaccgcaagcatcactaatccatccctgcactcctggaaagccgggtcagcctctgccggctgagctgagtggaccaccaggcgcctcctggttgtcctctgtgtgctgttttcctctgtgtgctcttgtcctgggctggaccacacctgaatattccagccaccaaagtgctcagcaggagctgctgtgtaggagtcccccatgaggcccaagcacctgagcttagtgacatacacggttgaacgctgggagaatgctgggagcctgctgtt

SEQ ID NO: 6658 - DNA, 4736 bp, Homo sapiens
  ENST00000371730
tggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 6659 - DNA, 5225 bp, Homo sapiens
  ENST00000371733
gccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 6660 - DNA, 631 bp, Homo sapiens
  ENST00000486505
tctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcgtaatcctatgaggtttacgtaggttaagttgaggccaggtgtggtggctcccacctctaattccagcacttcaggaggccaaggcaggaggatcacttgaggtagaaacgttgaagcacaatgatccttttgctcctggtggaacagttgttgcagcaagcgattcaggtaaataaataatttatcaacttcattgaacattaaacattttttttaagattcttttttctttgtctctaaatatatttgtcctgttatttatagctttaaaattattgcataattatatccaatagtaatttaccaataataagcatttgtatatcactttctactt

SEQ ID NO: 6661 - DNA, 445 bp, Homo sapiens
  ENST00000478657
agattttgttagtaaaatttttgctgtaatgtcttcccctccatccgtaacctcaacttgtgatcaaggtaagtatagttggctgtatatttcataaggtcaatgacattccttattttatctactgtgaagtgaagttattgaaataaactttgctttgcttttgtttgaaagttactctttaagtagtggtgtcaccacagtaaatattgttatttggatttctttgtgtttattttatcacaggtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttt

SEQ ID NO: 6662 - DNA, 987 bp, Homo sapiens
  ENST00000493793
tccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagaca

SEQ ID NO: 6663 - DNA, 1773 bp, Homo sapiens
  ENST00000371727
atgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacagtagtgcatgctaaggtaaatgaataaacacaatttatcttatatgcctggagcctattcccaggtaactggccttttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccttaccccgcctcccagttaatgtggaaattttgttataatgtcttgtttcattaatatagttaatacaggttgagcatccctaatctgaaaatccaaaacttgaaatgcttcaaaatctgaaacttttgagtactgacatgacccacaaagtggaaaattccactcctggtctcatgtgataagttacagtcaaaacttttgtttcatgcacaaaattattaaaaagattgtataaaattatcttagattatgtgtataaagtttatatgaaacataaatgaatttcatgtttagacttgggtcccatccccaagataggataatattccagaatctgg

SEQ ID NO: 6664 - DNA, 698 bp, Homo sapiens
  ENST00000464478
catgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttattttcctcattttccacaagagccagatgaaataggcagaatacatattaccacattttaaaaatgcagaaagagaaacttaaagtgacttgaattcttgttcacagacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacag

SEQ ID NO: 6665 - DNA, 731 bp, Homo sapiens
  ENST00000471391
ctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgtaagtaatctaatgttcttaacatcttcattatcttaatgattttctcatgtgcaaatttcctcttttagttcatccttagaggaaaactatattctcatcagattattgggtgaactttttttttttttctttttgagacagagt

SEQ ID NO: 6666 - DNA, 374 bp, Homo sapiens
  ENST00000465467
ctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaacatgataccagtagtcctttgctaatcagtggaacctctgcagctgagctcccatgggcttgaatggatttctgtctggtgataaagtgaaaccagtgttgctcaactctaagttacctgtggatatccttggaagagtttgggagttgagtgatattgaccatg

SEQ ID NO: 6667 - DNA, 561 bp, Homo sapiens
  ENST00000549282
attcattacccttccctggatctgggggctttcggaatctcgacctccccttggcctatctcctgcagaaaaattaggcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaact

SEQ ID NO: 6668 - DNA, 560 bp, Homo sapiens
  ENST00000549061
attcattacccttccctggatctgggggctttcggaatctcgacctccccttggcctatctcctgcagaaaaattaggcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtgg

SEQ ID NO: 6669 - DNA, 5919 bp, Homo sapiens
  ENST00000267101
attacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 6670 - DNA, 1027 bp, Homo sapiens
  ENST00000411731
tccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaattagctggc

SEQ ID NO: 6671 - DNA, 572 bp, Homo sapiens
  ENST00000550869
aatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtg

SEQ ID NO: 6672 - DNA, 4382 bp, Homo sapiens
  ENST00000551085
atttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatgg

SEQ ID NO: 6673 - DNA, 660 bp, Homo sapiens
  ENST00000546884
caattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtaagtggccgtgatc

SEQ ID NO: 6674 - DNA, 2755 bp, Homo sapiens
  ENST00000551242
aattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaa

SEQ ID NO: 6675 - DNA, 676 bp, Homo sapiens
  ENST00000549672
agagatatttattccaggacctagagagaggcaggatgagggtagagaagtgagtgccctagttggagggggagaggagggtaatcaaagttgcggccttttcctaacttctcttttctagggagagaaacaaattccctgtcttccttctcagttaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagata

SEQ ID NO: 6676 - DNA, 4353 bp, Homo sapiens
  ENST00000415288
atttattccaggacctagagagaggcaggatgagggtagagaattaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctg

SEQ ID NO: 6677 - DNA, 519 bp, Homo sapiens
  ENST00000549472
tccctacctcagagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctg

SEQ ID NO: 6678 - DNA, 574 bp, Homo sapiens
  ENST00000546748
aatggtcactgctttgggcccaaccccaaccagtgctgccatgatgagtgtgccgggggctgctcaggccctcaggacacagactgctttgtatgtaccctttccattgcctgggttctgaaattgggatgtggcctttgaggaggaggtaggggtacacacgtaacataaatctgatgagcctccttttttcccaggcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatgg

SEQ ID NO: 6679 - DNA, 277 bp, Homo sapiens
  ENST00000551176
gagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatgggttagagatcctgccttccctccttagaccccagcccacgcacccctcacagttcatttcattggccaaaactttcctatgtggagctgactaggaatcaaagtcataaaattctagcctgttacaaa

SEQ ID NO: 6680 - DNA, 971 bp, Homo sapiens
  ENST00000549205
caaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagatttgatccctttcttcaaggaagtagtgtggtcccctagaagaacactggtcagagaaatgggaggcatgcattctagtcctgattttgccattaatttgccacatgactttg

SEQ ID NO: 6681 - DNA, 266 bp, Homo sapiens
  ENST00000550828
ctagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttct

SEQ ID NO: 6682 - DNA, 2729 bp, Homo sapiens
  ENST00000550070
tgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaa

SEQ ID NO: 6683 - DNA, 306 bp, Homo sapiens
  ENST00000549644
gaatgtcggccctgccatgagaactgcacccaggggtgtaaaggaccagagcttcaagactgtttaggacaaacactggtgctgatcgggtatgatggggttggagattctggaaactggggatatttgggagttgggagagaggtggttacctggagagaagagggaggctgtcttcattctggccttttatgtatgcagtccactatcactggacacttgggactcaagaatgcaggcttctggacttcccttcctaaaattaactttcagtagtctaagactggtccagatttaggttggtcc

SEQ ID NO: 6684 - DNA, 3237 bp, Homo sapiens
  ENST00000553131
agaacactggtcagagaaatgggaggcatgcattctagtcctgattttgccattaatttgccacatgactttgaagaagttacttatcttctctgtgcctcggtttatgcatctatacagaggaaataacatttgtccttccaggatggctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctcttt

SEQ ID NO: 6685 - DNA, 551 bp, Homo sapiens
  ENST00000548709
atatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgtgagttacctgctgagcccaaccattttctctttttttctttttttttcttttttttttttttttgagacagag

SEQ ID NO: 6686 - DNA, 3289 bp, Homo sapiens
  ENST00000549832
aaaaaaaaaaaattagccaggcgtggcggcatgcatctgtactcccagctactcgggaggctgaggcaggagaatggcgtgaacccaggaggcggagcttgcagtgggccgagatcgcaccactgcactccagtctgggcgacagagcgagactccgtctcaaaaaaaaaaaaaaaagaatttgggacttggaaatcctaagaaaatttgtggaaataaacttgtgatacctctatctttaatccgcagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagtttt

SEQ ID NO: 6687 - DNA, 291 bp, Homo sapiens
  ENST00000552691
ggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggtaagttctgttgctgagaggctgggttttaggatcagattgatacgagtagtat

SEQ ID NO: 6688 - DNA, 12136 bp, Homo sapiens
  ENST00000342788
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgtt

SEQ ID NO: 6689 - DNA, 12084 bp, Homo sapiens
  ENST00000436443
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaa

SEQ ID NO: 6690 - DNA, 2680 bp, Homo sapiens
  ENST00000484594
atatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaaggtaagtgcctgtcaatttctatggaaattacatttttaggttaatatttcctaacctggaacagttttcatattgaaaatatgttgtcttcccatttaaataaaataaagtatatttgctgcaatgaaagatacataacag

SEQ ID NO: 6691 - DNA, 2194 bp, Homo sapiens
  ENST00000260943
tgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgcataggctcaagtattgaagactgcatcggcctgatggatagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggaga

SEQ ID NO: 6692 - DNA, 309 bp, Homo sapiens
  ENST00000463121
tgccacccatgccatccaaactgcacccaagggtgcataggctcaagtattgaagactgcatcggcctgatggataggtgtaacggtcccactagtcatgactgcatttactacccatggacgggccattccactttaccacaacatgctaggtaacatctaccatgtttccattttgtcgctcaaatcctttcctagttatcatgaacaaaaagtactaaccagttgggttaaatttataatatattgtaactcataatatatcaaattggaaagttttgaaagaggcataaaacactttccttctca

SEQ ID NO: 6693 - DNA, 582 bp, Homo sapiens
  ENST00000484474
aattaatgactctataaaaaagaacctagagagatcccttgccccttctgctgtgtgaaaacatagcaagacactggcctcaaggagtgggtcctcacaagacactcaatttgctgacaccttgatattggacttcccagcctccaaaatttctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgcta

SEQ ID NO: 6694 - DNA, 569 bp, Homo sapiens
  ENST00000435846
atttgttctcctggttccctctctgtgagatcttcttaatctgtgtctttcaagggaaggtcattgctgctctgaaggaagctgcattttgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggac

SEQ ID NO: 6695 - DNA, 444 bp, Homo sapiens
  ENST00000459774
atatggtcataacaaatgggattaagtttatctccttgctatatatttctgtggaatctatgccttcctactctctgtgattagcacatgtaatttgggaatataaaagtgaaaatgttcatcatgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcgggtaaagctgtggctttctttctcttctttgtgaatggacagtggcgtcatgatgcatacaggcagacctgtgtgctgatacctggaaggggtgctcttctgcctggcaggcactgtgactataggcaaaagataagagatagcgaaacgcacccaggaaaagaacaag

SEQ ID NO: 6696 - DNA, 11699 bp, Homo sapiens
  ENST00000402597
gcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgtt

SEQ ID NO: 6697 - DNA, 8647 bp, Homo sapiens
  ENST00000284037
ggacggagctggatcctgcttctcgccaaggcaggaagtgagtttcgcactgcaattccgggcggtgtcacgagtgaaaagttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaggaagtggagaagacatttttagtttatatattgttgagtaaattgtagttaaggcctatacccataactaactttagtaagtattatatagcaattcatcaaaaccacaactgtcttttagtgattttgtctttaagagtaatttcttactctaaccagtaaaaaaataatactgatcagagtaatttatacggcatacaatagttgatacaatctaaagatttatgctaattaaggaattatcacttcatctgaatcaatgaaattctaaaattccctacatatttattttgtaaatattcttctgacctctttggactggatatgaagatatatatatatacacttaattcttttaaacacaaaacttgccataagcagaaccaaacttttaagtattaatttgctgcacttaaaaaatcccattagcagctatgtaatatttttatcaaccaacatttattcattccaaatttttgtatatatctagatgaagtaacacatagaggatagataacaaactaatgatgtttaaactggtttatttacaaaattcggggttagagaaattctcatgaaaaatatacaatttttttttagcattaaaaccctgtatatctaggtgtggaagaagtgtagtttatctcaaattattattatttacttctaaagggaggcattaagatgggaaatgtttctctgatggagattgacgtgtgaaatctatttggaagggtatttttttcactcagtctgttgcattcttacagccttctgttttaatgttcagtgaataggtttcttatgaaatggacattgaaataaaaattatgattcaagagcattaattgatgaacaagtgaacaagatgcctctttaaaaaaaaaaaagaaaaagtaatctagacaggcagccaactcagacctttgggtattcctttgtttctaaataaggaccttcagaaaaagttgaccatattctacctaaagctgctaattctttacagaattcataagcccaggggatagtaagtagtcatttagttttggaaagttcttaagagaatgctatcttctacagtctcatgaagcagtttttcaagattagaatctgtggtcagctataacgtacagtcctaatatccaaccacctgagaagctcatcctaagctgagaaagcctaaaatgttagagaatgtttagagaaaacacctgaaattttttttaagagaacaacctaggttttattgtagagaacaatcaaaatactcctgaacctttctatagaatctttaggagagaggctgacaaaaagaatccttctgttacaactttcttttctaatgtaacaaccagggacaatggtgatctgtcacgcatctgcccatctagcttctcaatcggcccacggttttatttcaggataaaatttgagaaactagtatcactggggaaggaagaaacctaagctgtaaaattatgcttttcccctcaagggattcaataaagcttatttttcatgaaaacaa

SEQ ID NO: 6698 - DNA, 6410 bp, Homo sapiens
  ENST00000380943
ttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaa

SEQ ID NO: 6699 - DNA, 337 bp, Homo sapiens
  ENST00000507490
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagtctttcagctcacagcaggatgctaatccatgaaggtgacctcgcagtactggttaattaagctttattgctcactgaaaaagaaaaaaaa

SEQ ID NO: 6700 - DNA, 2351 bp, Homo sapiens
  ENST00000416865
tttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttagg

SEQ ID NO: 6701 - DNA, 4701 bp, Homo sapiens
  ENST00000380938
aaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 6702 - DNA, 4257 bp, Homo sapiens
  ENST00000511297
caaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaa

SEQ ID NO: 6703 - DNA, 4386 bp, Homo sapiens
  ENST00000506030
aaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaag

SEQ ID NO: 6704 - DNA, 4374 bp, Homo sapiens
  ENST00000508515
agaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 6705 - DNA, 561 bp, Homo sapiens
  ENST00000507128
tttgtaatttttctgttttctaaaagctgtatcttcttactgataatgcatgagtgcatatttttattgtatacttctaagcagtgagtcctattttttatttctttacaaattatataaaaacttgcccctgttgtgtaatccaaagcttaaatgtgttttttgtaatctactgctatggcatgtctctttgatttctccattaataattttctataataattttactgtagtaactataatgcagtagaaaggcttacatcctggctcttcttttttatttttccttctccctgctccttttatttaatgatttgaaactaaaggttattagaaattcccagggcttcttttgccagataaagacattcataaaaattaattgaattactgctatcccctaccctaatcccaacagcctgaagtacttgagcaactaagtggattgaaagagttttggatggatgctaatagactgacttttattccagggtttattggtagtttgaaacagctcacatatttggatgtttctaaaaataatattgaaatggttgaaga

SEQ ID NO: 6706 - DNA, 377 bp, Homo sapiens
  ENST00000515185
aaggacaggatgagggaatagaacattgggattgggagtggtatctcttttagatacgtttgttaggaaagttgtttctaattcttgtcagatgtagtatgtctcacactgactgttggtggacttgcttctattttaagctgaaaaattgtatgttgtttcttccctcattaggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagag

SEQ ID NO: 6707 - DNA, 589 bp, Homo sapiens
  ENST00000511671
atcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaaagcatccccagacatccagttcaggagatccttgtcaagatggtatattcatttcaggacagcagaactactcatcagccacacttagtcacaaagatgttcctccagacagcttgatgaaagtg

SEQ ID NO: 6708 - DNA, 544 bp, Homo sapiens
  ENST00000503913
tttttctctggtactgggaatagagttccaaatttaaactcagccaggacaattgggatgataatattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcatac

SEQ ID NO: 6709 - DNA, 474 bp, Homo sapiens
  ENST00000512354
agcatgctgtcaaggtcctttaattccaattttactactgtaagcagttttcactgtggcagctctagggatctgcatggcagccagggcagtcttgccttgagtgttgcagacagaagaggttctggtgggcacatttttcgaaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagag

SEQ ID NO: 6710 - DNA, 367 bp, Homo sapiens
  ENST00000505822
cttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgtaagttttctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaa

SEQ ID NO: 6711 - DNA, 641 bp, Homo sapiens
  ENST00000509946
ataatcccagctctgcctttaactcactaactcattaacataatattctatgttgtatttcacttcatctgaccaaatatttatttttgatgaattcttatgtttatgtttgcttggacttaaccaatcagtatttaaatatggatgttgttgcattataactttttctgaaatagtaagtttcctttattttcatattaactcagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagaggga

SEQ ID NO: 6712 - DNA, 673 bp, Homo sapiens
  ENST00000506744
gtaagttttctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgatttttaactttcttattgctttttcacacacctataaaagtaattttattactctcaagagaaatcactaaagtcagaattactagaggtaaaaataactagtttgttacagtattactcagagaagtcagggagaaaacttgtaccatgattcaaatatttgcatggtgtggaggaaaaattgctccttggtactctgttatttatacatactgtttttagttaaataattttttttgttgttaaagggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcgggg

SEQ ID NO: 6713 - DNA, 6692 bp, Homo sapiens
  ENST00000380935
cggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgagga

SEQ ID NO: 6714 - DNA, 6138 bp, Homo sapiens
  ENST00000288221
gctcgctcggtctccggctccggcgccggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtg

SEQ ID NO: 6715 - DNA, 3488 bp, Homo sapiens
  ENST00000486496
gagaagctgagcacccatgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaa

SEQ ID NO: 6716 - DNA, 2594 bp, Homo sapiens
  ENST00000484530
gagaagctgagcacccatgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcaggtccaatgtttacttttacccttttggagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaa

SEQ ID NO: 6717 - DNA, 968 bp, Homo sapiens
  ENST00000473469
tcatgtctgcgatagccttttagacgtcaacaccaaggatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcaggtccaatgtttacttttacccttttggagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatg

SEQ ID NO: 6718 - DNA, 904 bp, Homo sapiens
  ENST00000469720
agttcatcgggaggcggggattgtagtgcaggaaacgagaactgggcaggggaggtcactaaatactaatgaagactgccagcagaggaacctacagaggatttttgttcaaagaggacagtttgaggaggaggatgggtaacaaaaatgtgtccttcagcagtcggcctgtggtgagctgaagaagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatg

SEQ ID NO: 6719 - DNA, 3831 bp, Homo sapiens
  ENST00000460849
cggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttgg

SEQ ID NO: 6720 - DNA, 580 bp, Homo sapiens
  ENST00000468118
gcacagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggatttta

SEQ ID NO: 6721 - DNA, 532 bp, Homo sapiens
  ENST00000487287
tttcagagaaggtgaattctgggttatagtcctagagctgtgtccataactgcatctcagtgttcctggtgtcttcaagattgccagcccttcccaacctgtgccagacataagaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccagctattagaagggctgaataaagggaacatgcagctctgcagcaatattctgataatgtattgcagtgcggctcacatcactgtccaccaccacctggagcggctcatcagaactgaaggggagttttcacttacctt

SEQ ID NO: 6722 - DNA, 689 bp, Homo sapiens
  ENST00000466358
tgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcaggtccaatgtttacttttacccttttggaggtgggtaacggcaaatgctgggtgctgggtttcagagagactctgcataatgagcttggatttgggggctcacatgtactttacattttgctagagtgtaggagttgctatttttgtatttaattcacagccagactgttccatgattcccacca

SEQ ID NO: 6723 - DNA, 1585 bp, Homo sapiens
  ENST00000492584
gaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaagcaagctgagcagttgttcaatcagatgtacaacccagcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaa

SEQ ID NO: 6724 - DNA, 599 bp, Homo sapiens
  ENST00000484857
attttctttcctctgtttccttgctgtgtttgtattgggagcacagagtaatgtaatttagtaaattatgatttgatggctgggcatcagccccagtgttgaacagtatttggactatgattacttgctggctttgtcacagttgacattaattattgatggaagtttcagaaatagcgcatgtgccaggagcttttcaccggaacgcaggctccaggcaggagggatgctaaagagtgtgggggaagagacacctgtggcttgtttatgtctgtgcaaggggaaccaggacccagcaggctgtgtagtacctgtgtaaaggttgtggtgtaacggaaggatgaaccgtcaggcttatttctatcgtgttcctccccaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagttta

SEQ ID NO: 6725 - DNA, 658 bp, Homo sapiens
  ENST00000477381
tcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcagttgcaacagctgttcagatgtacctccttctgaatagaagaagaaaatgttaatttctgtaagaataaagactttaagagcaacatttagtgggccacatttgactggtgaattgatttttattttgaagcaccagcaccattatttcccactagaatgagtgaagttgttctctaagtagcagattgaacaatatgaaatggaattggatcaaatgggtttgttatgttagagatacacaataaatttttaacttgg

SEQ ID NO: 6726 - DNA, 629 bp, Homo sapiens
  ENST00000472917
ggggatacagctgtgagaggcagacaagcgggaagaaaactctttgaaaatggacttttagaaatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggta

SEQ ID NO: 6727 - DNA, 3831 bp, Homo sapiens; identical to SEQ ID NO: 6719
  ENST00000612797

SEQ ID NO: 6728 - DNA, 2881 bp, Homo sapiens
  ENST00000393784
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaata

SEQ ID NO: 6729 - DNA, 1000 bp, Homo sapiens
  ENST00000519860
cggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagtgcccacacttggtgaggaatcggtgcaggcttcctggcagtggctgacgcagagttaaaccattcctgattcctagaattatctgttgtctggataacctagtaaacgctctggggtgtgtgtaacagaatgccattaggattatgcagtcacgacctcatcggacgcccctctgtgatggaattagacccaggagcttcctgcctttggcactggcttgaggcttcaaagcctcttcatttctgtgtttacagcccggaaagtcatcacggagctcggccctggccacccactctcctgctcaacactggaattttctttttcactaatgggatttcttggtttcctttgcctccactcagccacaagacaataggaaactaaatacatagctgcttagcccaagaagactctcattatacaagcattaccacctttagttctcaaacagcctcaggagggagctgccccctctttacaaagaggaaattgaggcccagggaggtggagggacctgcccacagccatacagttaggagctggctcccagccctgcctatctccctagcccacatgtgtttgaccagcacactgaaaggcctatgagacaggagggctggtctcaccttgtttctgggtatacctttcagccctcccctggcatgggagagtttgcctttcctggtcactctgatcctgttttaaccctgatggcgccaaagcccaggggaccttttacagtggtgggaa

SEQ ID NO: 6730 - DNA, 647 bp, Homo sapiens
  ENST00000520326
ggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggtccccggcaacttccacgt

SEQ ID NO: 6731 - DNA, 539 bp, Homo sapiens
  ENST00000520642
gcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggtccccggcaacttccacgtgtccacacacagtgccacagcccagccacagaaccca

SEQ ID NO: 6732 - DNA, 586 bp, Homo sapiens
  ENST00000523291
acgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggaagttgaccagcagccagatgtcagagtttgcgtgttttgagcagcagcggcagcctcaccagagaccccacggtgacctcgtttcatcagccagccccgcaggaggaggacaggatggggtgaggggtatggggcctggctccagctatatgtttttaaaatccatcagagacactgacgtaggttcctaagtcacaggctctaaa

SEQ ID NO: 6733 - DNA, 554 bp, Homo sapiens
  ENST00000518247
aggcagcttcctggctgggaagggaagcccaggctctccttagttgactgtgtgttaatcacccagcaatttcattactcaacagctctccagagttgcacattacagctggggtagaaattgggtgctgaaggccaggcagagcatttggctgtagggaggccgatcctcctcgggcctgttaccggcgggtctttgttcttagacctggggttcttggcctcacggattccaaggaatggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatcc

SEQ ID NO: 6734 - DNA, 3952 bp, Homo sapiens
  ENST00000326654
gaagcccaggctctccttagttgactgtgtgttaatcacccagcaatttcattactcaacagctctccagagttgcacattacagctggggtagaaattgggtgctgaaggccaggcagagcatttggctgtagggaggccgatcctcctcgggcctgttaccggcgggtctttgttcttagacctggggttcttggcctcacggattccaaggaatggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatggaagccctgcctcagccctttctacctgctcccctttcctgctgtctccccgctccctggaaactggttgtggaggcactcactcgacctgaccctgacacagcccccagcaagcgagggttcgtgtccagctgcctggccgttcctgctgagaatctggatgggggtccaggctccctggggttttaagcccctgatggctggttcaggaaggagctactcttctctccagtgagggggacaatgatgagaagacctgaggatttgcagcccccagccctgggttcaagtcccagctctaccccttcttggcccctacaagtcacttgacccatcttaggctgagggtgtgatggcgataatagtatcacgataccacccacttcacaaagtttgtgtggggattaaatgagctaatgcagattcattcattcagaaaaatttttgaatggcacgttctgtgttccagggtcggtgataggctctggggcagcgttcctgggctggtggggctcccattctggtagagggagacagtctacaaaccagaaagcatcagggatgctaagtgcagtgatgaggaataaagccaaggggagtgagatgaggtgggcttgaaagtaccttgtccgctcagaaggaccattcaaggttcactgttgttttgtcctcagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggttaggatgctggggcccagagaggttaagtgtcttgcccgaggtcacacagctatctgcatgtcccacaactccccttcccagccccagccaaactgagccactggccactcctggcttctccttgtccctcctgcagcctctgctcagaacgcccttcctccagaccctgacacctgagctggggttgcaaagtcactggccacatccagcccaaagataaattttgtttgtccagtatagcatttaactgcatcagaaccagtatgaaaagaccaggaatccagatttctggcttttaaaagtcagaggctctcactacactgggtccgtgttcccgctatgacaatgacctggcaccaatgggcagtgttcccctttagagagggtgtgtgctgtcccttcccacagtccctggcaggcggctggaaggccaggcctggtcatctgtcaagcagggtggacttcttacgtgacagttcagggctcccttaagtgctaaagcagaagctgcaaggctttcttaaggtttcgagtgttgctgggagaaatctgctgcatgttgtgggttaaagggagtctctcaccagcccaggccctcaggaggaggagataccaggaggcagggatgctgggggtcgtggttcactgggggctctctctgcccatgagctgccacacagcacctttgccatgccccgtaatttggattttatggtggttgtgatggaaagccatttgagggttttgaacagggaggcaatgtaatcagatttatgccttagaactggactatccaataggttgccaccagccacataaggctatttaaattaattcaaattaaatgtacaattcagtcactcattctcatcaaccacatttcaagtgctcaaagccacgtgctggctaggggccacagcgttagacagtgcagagagaaagcacttccatcgctgaggaaagttctgctggaccgcacacccttagaaggatggctctggtggccgggcgcggtggctcaaacctgtaatcccagcactttgggaggccgaggtgggtggatcacgaggtcaggagatcgagaccatcccggctaacatggtgaaaccctgcctctactaaaaatacaaaaaaaaacaaaattagccgggcgtggttgcgggcacctgtagtcccagctactcaggaggctgaggcgggagaatggcatgaacccgggaggtggagcttgcagtgagccaagatcgtaccactgcactccagtctgggcgacagagtgagactccatctcaaaacaaacaaaaaaaggatggggctgggctggagagggtggcaggcagtggttgtggcagtggagctggggagatgtggtcggattagggaggtagaatcaataagactcagtgaagaatcggatgtgggggtaagggcacatgtggaagcaaagaaacctttgacgtctttgtcttgacaaccgggtggtcctgtttctagacatggaagcttagaaaagcctggagtctgtgggaagtaggtagggctgggcactggtcattccactctggtttcctttggggttcccattaggtgtctacagggagaggtgaaattggaagttggaggtgtggagagttcaggagagggttctggaccacagatgttgaggtgggagtcattagtgaatagatgatgttggaagtcatgggtcctcagagtgggggctccttaagcctccaggccagcagcatcagcatcacctgggagattgttaggaatgcagattctcaggcccccctaagacccaccgactctgtgctagaacaagcgcccctcagagattctgatgccactgaagtttgaggagcattggtttaagcaagattacctacggagaggctgtagatccgtgttctaaacctggggtccacagacacccccaagaagagcggattgaatgcaagagatctatgaagttggatgggggaaaaattgacatctttatttttgctaaactcgatctaaagtttagcatttccatctgcgatgaatgtaggccacaaaccacagtagtattagcagtgcctgggacctcctcaacaacagaaattgccggtatttatagcacgttacagttgttgcagataatttccagagactgtttatatgcaccactgttttaaaattacggtgattggccaggtgcagtggctcacacctgtaatcccagcactttgggaggccaaagtgggtggatcacttgaggagttcaagaccagcctggtcaacatgtcaaaaccctgtacctacaaaaaaatacaaaagttaaccaagcctatgcttgtagtcacagctactcgggaggccgaggtgggagggtcttctgagcccagggaggtagaggcttcagtgagctgagatcgcaccaccacactccagcctgggtgacagagtgaaacccttaatcaatcagtcaataaaaattacagtaattattagacccaccactaggtcatcttatttgatgcatcagtaaagcagcatattcaaatgtggatttttaaatattttaattactatttaaatatctctttactttgtaatcctatgcattttacgcattaaaacattttaagcatttaaaa

SEQ ID NO: 6735 - DNA, 501 bp, Homo sapiens
  ENST00000519567
gaaatccagctagtcctgtctgtcataacctcctgggctcctgtttgcctctctccctccagctcctttgctcttggtggcctctgattggggccaacactacaagcaaggtcaagcgcagtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacct

SEQ ID NO: 6736 - DNA, 578 bp, Homo sapiens
  ENST00000519796
tgtgaacgagctctatgtcgatgacccagacaaggacagcggtggcaagatcgacgtcagtctgaacatcagtttacccaatctgcactgcgagttctttggaccccagaccatgagctcctggaggtccccagcccggcctgcccctgcaatggatgaatgaaggctcccagagagaacaggctggcccccatcctcccgcgtctctgggtttgtgactgttgtctccctttggctcctgcagtggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggt

SEQ ID NO: 6737 - DNA, 488 bp, Homo sapiens
  ENST00000523650
gaagttgaccagcagccagatgtcagagtttgcgtgttttgagcagcagcggcagcctcaccagagaccccacggtgacctcgtttcatcagccagccccgcaggaggaggacaggatgggacatgcttacaaaatcagactttgatgggctgctgcacgataagctatattccctcctcggacacagctcgcacagtcttcttcattgggctggaataaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaag

SEQ ID NO: 6738 - DNA, 566 bp, Homo sapiens
  ENST00000521392
agatggcatccaggcatcagaggagggagcagtgcgtccaacagacgtgagctgagactgcagctctcgacatgtgaccttagcaagtttcttcactgctctgagcctccattttcttttctgtaaaatgggaattatcagatgacaaagtcaaaggattcagtgttgtttgtttagtcattcattcattcaaaaagtgtctattgagcacctgctatgtgtcggagtctggggagcacagcagggcgtggacatgctaatgggaggaggcagacgagaacaggatgggtatgagatggcaggtgatcccagaggctgtagcaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactc

SEQ ID NO: 6739 - DNA, 456 bp, Homo sapiens
  ENST00000523366
gctacaggtccagaacatccacggagctttcaatgctctcgggggagcagacagactcacctccaaccctaaccagtgggaaggtggacccagccccgtccagacccagaccctgatggagaaggaagaaggcttgtcccggggcacagcagacgcacgcacgcagtggataccagctattaccattattgttgctctcatcacagccacatcatcatccttagttgaactaattacctaagatcccacagggagctatggcagaaccaggatctgttctgcctccaggtcgcaccgtgagaacaggtctgtgggtggcccagtcagctgtgaccacatggctgcctcccccacacctcactctcctcctgctcagactcctcccatcgatagtggctcctcctagagtcctcgccctccttagctccctggcaccttggcccagatcaaagagaa

SEQ ID NO: 6740 - DNA, 5687 bp, Homo sapiens
  ENST00000520399
agaagaggactgactcgactctgcgaccaggcttagaacccacaggcctaaatttctgtgttattttagctctgtagtccgtgacccgagattgtggaaggcccatgagcttcctccctggcctcccacgactacatcctgaagattgtgcccacggtttatgaggacaagagtggcaagcagcggtactcctaccagtacacggtggccaacaaggtgcgcgggcggtggctgggccgagctgtgtgcggcggcgccctctgctgacggagagcagagatgacaggcggctgcaccgacgcactttcttctgattcctttctggaggcctttcctgggggttagcttgggccaggcgctgtccctgggtaaaattgaaaagcccagtccctgccatgtggcagtctcagagtcaaggagaacagatctaaccaggagatagggtgtgatgcgtttgacaaagagcaggtagtctctgtcctacaaaggtcctggggttgcaggtctcaaacagccctgcatctggtccgagtccttcagacacagacccctgggtgctcaacacagacagacactcctgctctcagggcacaggcactttacccaaactcatgaggctactgagtcacaccaagatggctgttgattaatttgctgttgattgacaggggtgtccccaggaccccaacactcaaagtcatggagaagacgccaggccttagtgggcagcagagcatggtcagagtctgcagagtgggatgacccagcaattagtggtctcaagacaagacagccttgggcttccctgggggtatcccaccaatgggacatgaatacttgaaacctgttggttgaaatgcccctgctagaccctggcggatgggtttttcccacttaccaccaggactgtcctttttcttctgttccaaggctgcccaaaccccttataagtgatacctgtttagctcagttaattataacaacagtaggaggcatagctgtcactcattgagtacttcctgggggctagacatgctaagctctcttcttccgtcttctcaatcatcatgacagctctgatgttgagactgttattgagcccattttgttgatttgaccattgaggcactgagaggtggttgtagagctataaagtggctgagtggggattagaacaggttttccttgggctccagagcctggcttcttgatcacctcacgcctcggtctgaggaaggggctgtgagtctgcccacctgcgagctgctctctgtccaatgacttagtccctctgttctgactcaccctaaattgatgttcccgggagcccctgtttcttttattcactgtttcacagggggcatctcattgtaaccctcacatgctcatagcagctaacagatggaaaagcacagatgcaagctcaggaccacgctgcagttcaaattccagctcagtcattcactagctattgaccccggacatgtcacatagccactgtgtgcctcagtttactcattcataaaatggagatgatactttataagagtgctgtcacatgaggcaatgttttcaaaaatgcctagcccaccaaaaaaaaaaagcctttaggtaagtgatactgactgctgctatttttcactctttttctctgtccctcagctctgggttgtgacccagacagtcatcctgccccagcagctctcctggagaaagctggtcttcccttgcacaaagctccttttcccaatgctttggcaaggcccagcagccaaatacagcttgcttagcttctctatggctgcagccgcactctgccctgggagcaggcagcagcgacccagcgggaggtcagggctcagtgttacttacccccggagtggcctgggctcctcaggctcagcatgtggggttgggggtaccccagtggttcaatttggcctccagttgttgcagactttagcaccttgaagtgcccaaactggagagatcccagggatcatcatcccaggcccatccgtgtttagatggggaagccaagtccctgagggagggaggggctggcccaaggatgcactgttagctcagcctcgtagtatccttagtccctgctgtgtgcattctcaggaaggttggtggcagggcggggccttctggctttgcagttcagtctattcctctgaagaagctagcccactccccacgtggcatttacacccatcacacacacacacacactgggactcctgcttattcatcatgtgtggctcagaatgtcccctccccagtctcccagatgccgcccgggagaatgggtcattcattcattcccctcaactctccatgttcctccatcccacatgcatgatgtcacagtgttagggatattcttatgtcttcctccttctgcagactgcgactccctctgggtaaagggcaggacttgctcacctcggggtccccagcagccagccatgggccaccacagtggaggcgttcagcaaaccattgttgaataaatgaatggatttcgcgtggcccagaggttgaaggaggcaatagccaaaaattgcacttttccttttacagctctgctttctaatttattttctgattctggtgctgcttgcagctcacttggtcaatttctaaacaaccaagggtatcaaaaatgcccagctgtgcacggcagagttcagggcctccaggggaagggatgtgagagagggagtgggggagtctggcttcgtggggcagagagggaggaaagccctttctggagggttgctggggggccctctgcaatccagtccccgccccccctgagacacagtttgtacttctgattcttatatcctctaccccaggaatacgtcgcctacagccacacgggccgcatcatccctgcaatctggttccgctacgacctcagccccatcacggtcaagtacacagagagacggcagccgctgtacagattcatcaccacggtgagtggcctggggcagtgggtggggccctgagccagccaccctgcgcctgctctgggcccctttccttggcacccctcacctgttctcgctgaaacaggaggcagcctgcagggctaggggctctggctgggcacaggaggcttcgaccccaaggatgctgagaaatgttgtcagaaacacatcagtatcgatgacgttttgtctagaaagtattttccagaggggaatgccctgaaatccatttaattcctgaagcaaatctccatatggttccactagatgtttaggattttctccagctttttattgttatggaaattattcttagcagagtttatcctttaatgtgtaaattttgcaccaaagattgaactcatttttttttccaggtctaatttccagttatagctgctgatagggtccgatttttccctttccttcctctctgttctctcttttttgccatggtctctaccacatccagttttctctagggcagattcaagctgatgttagttttcctttatgctgattatttctatcatgtctactgtttcctggcctcccattcagaaggtccttagggtcagaacaggagggtcagggtgcccttcttcacccaagaggcccaggaggtactgaagaagccagagttagctgaggtggaagagacagggtggctatccctacttcacagatttggaaactgagacctaaagataaatatggcattgggaggcccttatgcttctgtacttcttcatgcttgtaatgatggttcaagatcaagggccttggctctttcatttcccgcaataactaggtcagtattagtcaggactctgttaccgaagatccagaaccagaccttgagctggcctgaggagtagaaggcctcaggcatggctggatccagcctccaacattgccaggagtaggtctctatcttcggatctgctttccgctacactggcttcatcttcaagtagaatttaccagtagaaatggcctctttctcagtcattctaaccaagtcctagataggacagagctctcactggcccagctcaggcctcatgccatccttgtggcctgggaaatcaaatgctctggttggccaggcttaggccctgtaccctctctggtgtcaaccccatccaaaccgcagggacacagattgtgaggaatgaggtttctcaagagaaaaggcaggggccagctactggaagaggaaagagtgggtgccaggaggcagaacagtgggatgttgtgacagggtctctgccttctcatctgtgaagtaagaacgatcatctctgttcctgccacctcccagggccttgtgggactcagaggagattgtgaaaggagaagctgtttgcagatgtgaaaagccaagtaggacggggcacagtggctcacacttgtagtcccagcagtttgggaggctgaggcgggaggatcgcttgaggccaggagtttgaaaccagcctgggcaacattgtgaaggcttgtctctaagaatcttcttaaattagctggatacggtggtatatgcacctgtagtcccagctacttaggaggctgaggtgagaggatcacttgagcccaggattttaaggttagagtgagtcatgatcgtgccacttcactctagcctgggcaacagagcgagaccctttctctaaaaaacaaaaatccccagaaaacagacagagagatacaaagggtgtcataagtctggtgcttacatgagcctcagaacagttttttgctgttctctttgaccacataaaagttagaaactcctgttcaacaaacggcacataacataaagcaaaaatctcacacgcagcctgggaaaagatacttgccatccaaatgggaaaggggtagccttcagaattcatatgtaaagaactcctacagatcagtaagaaaaagttaacaaccaaaaaagcagacaaggccaaggaccagctcttcacagaggaggtgatattggcagtgaaaagatgcccaagttcactagaaattggagggatgggatttaaaacaagactcaattcaggccagacgtggtagctcacacctgtaatcccagcactctgggaggtggaagcaggaggatgacttgaggccaggagtttgaaaccagcctggtcaccgcagcaagaccccctccctacaaaagaaaagttaaaaaattagctagacatagtggtgcatgcctgtagtttcagctagttgggaggctgaggtgggaggattgcttgagcgtgggaggttgacactgcagtgggccatgatggcgccactgccctccagcctgggcaacagtgagacccggtctcagaaaaataaaaaaattaaaagacccagttgaatcctattggactgacagaaattgaaaacttgcccggctcacacctgtaattccaggactttgggaggccgaggcgggcagatcacctgaggtcaggagttcaagaccagcctagccaacatgacaaaacactactaaaaatacaaaaattagcggggcatggtggtgggcgcctgtaatcccagctacttgggaggctgaggtgggagaattacttgaacctgggagggagaggttgcggtgagccaggatcactccagtgcactccagcctgggcaacagagtgagactccgtctcaaaaaaaaaa

SEQ ID NO: 6741 - DNA, 3621 bp, Homo sapiens
  ENST00000523215
attcactgtttcacagggggcatctcattgtaaccctcacatgctcatagcagctaacagatggaaaagcacagatgcaagctcaggaccacgctgcagttcaaattccagctcagtcattcactagctattgaccccggacatgtcacatagccactgtgtgcctcagtttactcattcataaaatggagatgatactttataagagtgctgtcacatgaggcaatgttttcaaaaatgcctagcccaccaaaaaaaaaaagcctttaggtaagtgatactgactgctgctatttttcactctttttctctgtccctcagctctgggttgtgacccagacagtcatcctgccccagcagctctcctggagaaagctggtcttcccttgcacaaagctccttttcccaatgctttggcaaggcccagcagccaaatacagcttgcttagcttctctatggctgcagccgcactctgccctgggagcaggcagcagcgacccagcgggaggtcagggctcagtgttacttacccccggagtggcctgggctcctcaggctcagcatgtggggttgggggtaccccagtggttcaatttggcctccagttgttgcagactttagcaccttgaagtgcccaaactggagagatcccagggatcatcatcccaggcccatccgtgtttagatggggaagccaagtccctgagggagggaggggctggcccaaggatgcactgttagctcagcctcgtagtatccttagtccctgctgtgtgcattctcaggaaggttggtggcagggcggggccttctggctttgcagttcagtctattcctctgaagaagctagcccactccccacgtggcatttacacccatcacacacacacacacactgggactcctgcttattcatcatgtgtggctcagaatgtcccctccccagtctcccagatgccgcccgggagaatgggtcattcattcattcccctcaactctccatgttcctccatcccacatgcatgatgtcacagtgttagggatattcttatgtcttcctccttctgcagactgcgactccctctgggtaaagggcaggacttgctcacctcggggtccccagcagccagccatgggccaccacagtggaggcgttcagcaaaccattgttgaataaatgaatggatttcgcgtggcccagaggttgaaggaggcaatagccaaaaattgcacttttccttttacagctctgctttctaatttattttctgattctggtgctgcttgcagctcacttggtcaatttctaaacaaccaagggtatcaaaaatgcccagctgtgcacggcagagttcagggcctccaggggaagggatgtgagagagggagtgggggagtctggcttcgtggggcagagagggaggaaagccctttctggagggttgctggggggccctctgcaatccagtccccgccccccctgagacacagtttgtacttctgattcttatatcctctaccccaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcag

SEQ ID NO: 6742 - DNA, 1761 bp, Homo sapiens
  ENST00000318528
ccccctgacatcctccctatccctgctttaggggcttttcctctcttactgtgccataccctccaccgtctcccctcctgtctcctgggctctactcctccctgccctcctctgcgtcctggccctcccgctctcttccgctttgcgctcccaggctccttccacctcctgccagctcccttcctcctccaggtgcgcaccccctaccattagccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcgtaacttcaaatgagcatttttcaactgcagaagaaagtgagtcctgctttgcccaaccaaagccacatgcactgggaagagaatctactgttgatggcaatgtacaaagggaaagccgtcctcccttacaaaagctcaaggtttcagcagagcctacagctaatggtgttaaacccctccaagaacagcccctggccaaggacgtagcccctggaagggatgccacagaccaatcagggtccacagaaaagactcagcctggagagggactggaggaatctgggccgcctcaaccaggtggcaaagaggatgccccagcagcagaaggaaagaagaaagatgcaggagcagggacagaggccgagtctctaaaaggaaatgctgaagctcagcctttaggaccagaagccaagggtcagcctttgcaggcagcagtagagaaggactctctcagagcagtggaggtcactgagaatccacaaactgctgcagagatgaagcctctaggaacaactgagaacgttctgactctgcaaatagctggagagctacaacctcagggcacagtgggaaaggatgagcaggccccgcttctagaaacaatttccaaagagaatgaatctccagaaatattggaaggaagtcagtttgtggaaacagctgaagagcagcaacttcaggcaacattgggaaaagaggagcagccccagcttctagaaagaattcccaaagagaatgtaacaccagaagtattggacagaagtcagcttgtggaaaagcctgttatgaatgatccattccataaaactcctgaaggtccaggaaacatggagcagattcaacctgaaggaatagttggaagcatggagcatccagcacgaaatgtagaggcaggagcatatgtggaaatgatcaggaacatccatactaatgaagaggaccaacgcattgaaggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 6743 - DNA, 596 bp, Homo sapiens
  ENST00000545282
agccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 6744 - DNA, 3793 bp, Homo sapiens
  ENST00000410096
gatgcctttaactctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaag

SEQ ID NO: 6745 - DNA, 3760 bp, Homo sapiens
  ENST00000397283
cacaactgtctctactgccaaggtgctaatgccgaacccctgtgggatctctggtccaaggaaacatctgcacacaggccagggatggcgcttagcttcatctgtgctgcaaactctcatcagtaggcttgctggctctgtgaccttactagctgaactccttaatctctctgcacttcatttttctagtctataaaatggagataacaacagcacctacctcagaagactgttatgaagactctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgactt

SEQ ID NO: 6746 - DNA, 1466 bp, Homo sapiens
  ENST00000409395
cttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaaggctggtctatttgacagctgtgaccccagacaactttctgtctcccgaagcctgagtttttttcactagaagaaggcggaataataataataactacaagtctaggaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccct

SEQ ID NO: 6747 - DNA, 1246 bp, Homo sapiens
  ENST00000420719
aatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagt

SEQ ID NO: 6748 - DNA, 541 bp, Homo sapiens
  ENST00000420317
atagacctgaatgggctcagccctagacacacttttaaagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgg

SEQ ID NO: 6749 - DNA, 590 bp, Homo sapiens
  ENST00000411762
agagatgtcttccaaggacaagggagaggggattatacaagagtgaggtgttgtccctgatatagacctgaatgggctcagccctagacacacttttaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcacc

SEQ ID NO: 6750 - DNA, 746 bp, Homo sapiens
  ENST00000409216
aatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagacggagtgtcactcttgttgcccaggctggagtgcaatggtgcaatctcggcagactgcaacctctgtctccagggttcaagcgattctcctgcctcagcttcctgagtaactgggattacagggcatcagtgggagaagattcctctgagtggcagtaaccaggaaataagaagacagaaggagaggattactgagcagcctctcaaagaggaagaagatgaggacagg

SEQ ID NO: 6751 - DNA, 556 bp, Homo sapiens
  ENST00000409925
ggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagacggagtgtcactcttgttgcccaggctggagtgcaatggtgcaatctcggcagactgcaacctctgtctccagggttcaagcgattctcctgcctcagcttcctgagtaactgggattacaggcacctgacaccacgcccagctattttgtggcatcagtgggagaagattcctctgagtggcagtaaccaggaaataagaaga

SEQ ID NO: 6752 - DNA, 594 bp, Homo sapiens
  ENST00000419116
aacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaagagaaactctttattgttcataaggctatcacagatctttctctccaagaaactagtgctgatgaaatgacattcagagaagggcatcagtg

SEQ ID NO: 6753 - DNA, 1826 bp, Homo sapiens
  ENST00000512784
catggggctgggtggagttggaagtctagagctttttgctgttttgtttaagacctggttatggttgtgagacttttttttttttttttttttttttgtcagctgcctgttatatcaatcacggagtcgggatctatttataggttgggagtactgtgtccttagtcacaaagagacacagacaggggactgtcagctggtaccggaggagcggagcaacgagttatcagcaactgaaagcacctgaggggccgcacattccaccccagcccagtcctcgtcctccacgccagccccaagcatgctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatc

SEQ ID NO: 6754 - DNA, 2432 bp, Homo sapiens
  ENST00000505752
ttcaggaaaagccatcatgtttccgcagcatttatctgtcagcaggagactattatgagagcacaaactcacattgtattagcgttatcagttaattatgatccttgggaccagtgccagccaatgggctagcagtctgctgaccatcactcagggatataactccacacccccaaattcaagcatgtaagaagacagcaggtccgcagagaggtgtggtcagggacatttcccctggccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaag

SEQ ID NO: 6755 - DNA, 736 bp, Homo sapiens
  ENST00000507951
ccccgccgtctttctctaccaactgggaatgctaaaacgggactgatggacgtgtccgaactctgcatcccggaccccctcggctaccacaaccagctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccatgtg

SEQ ID NO: 6756 - DNA, 2745 bp, Homo sapiens
  ENST00000380887
tccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaactat

SEQ ID NO: 6757 - DNA, 1427 bp, Homo sapiens
  ENST00000556177
tttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggtgtgatggccccgcacacggaccaatgcccacctacagacagacaaacggacagaccg

SEQ ID NO: 6758 - DNA, 443 bp, Homo sapiens
  ENST00000509323
gccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaagagctgtgctgtctaatatggcaaccaccagccacacgtggctcccgagtgctggtccaaacagaggtgtgctgagtgtacaacacatgcctgctttagaggacttaataggaccataaaaggcagtgtaaagtctggtggtgatccttttaaaaatgtgattgcatgcagaaaggctaatcttctggacatgttaaataaaacatattgtgaaatta

SEQ ID NO: 6759 - DNA, 2190 bp, Homo sapiens
  ENST00000611036
ggcaccgcgagcacgccagctctctggcaggacccctgcagtccccctggctgtgccaggtaaccaaccgtcttggtttgtccaggacgtttctttatcccaggaaactcctctaccccaggcacacggggacagtgggtcactctatttctgtggatggccgtgaaagttttcactaactcaaggggcagccctgaacacccatttgtgctcacaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccaggtaactttctgcagcttttccatagaagccctggtcccacctccttggctctaccccaggaacctcccggcctgggcttctgggctgggacgtgctgaggtcatcccagacaggagggagggctggctgaaatccacaaactgcagagcagctctctgatggtgtcccacacagaaaatgttaaggatttcaagagccctcccagaccagtgatgtgtccctccggctccccttgcctgtggggaatcgggtctgagtcacttgatgagtaggcactggagccgttacccaggatgctgcggccctagccctccatgcagcccatcttccctcatttgggtggaggcacacatttggggcaaaggccccttcttggcatcaaggaacaccagctacaaaccaagtctagcacagtgtttagaggctctgccctgaggttctgctccggagaaaccttcacagtagagaccttggggtgtgtgctttgggactccctcagtctctcactgtgctgtgtccttgcagcggggccgaggtagcaccctgctctgtcacttcctgctcaagctggaggacccaggcggcagggcatcatgcccagctggcatctgctgtctgtcttttctagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 6760 - DNA, 2849 bp, Homo sapiens
  ENST00000509242
ccctctccatgtttgagggccgaagagcctgcatcgagcagagccaccaggctaaatcctctgaccttgactttggtttagggaccagagtctggtatctaagtgcgatcttactctagctttcccatctgttctgtttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 6761 - DNA, 479 bp, Homo sapiens
  ENST00000474874
gctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaatacaggcagaaaactacctggcactgtgggagactgagtataggagaaagcaggatgacgatgggcctgaatggtggtgtgttttcctccacacaatgtggctttgtcctccaaggtgtctcacgtgatggaagctggctgatctgacttgcttg

SEQ ID NO: 6762 - DNA, 3104 bp, Homo sapiens
  ENST00000377482
acggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataccatta

SEQ ID NO: 6763 - DNA, 2097 bp, Homo sapiens
  ENST00000467067
cagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttggtatgtattctgaaaatctgatcacagtaagcatttgagaagaacagtctggattcgggttagcttgtcctccagcattattttttaaatgaggaaacctgaactatttccaacaacagcctgacccctagtggcaacagattcagaagataactgtgtttttctcaagctattgtactcgactgccttcattctgagtcactgattgctaagtaggactgttcatggacgtgggatcttctaaaatcaagaattagttctcattccagctctgatgcatactttacttcatgaaaccttaggcgagatttcccacctttcttactagtatcgaatgcatgtttgacagtaatagatgaaaatagtataaatgttcctcaaaacttaaaaaatagtatttttaatgtgaatattctgttccttggatctttgtcaagagctgtgtgtgaactgaacacattgcaggcaagtccattcactcacaatattatgatgtgccagcaataaggactttgtcttatctcattggtaccctacgtgcctagtatggtcgcatgtcttaaatggcaaggctggtacagtatggtattcatgtaaattatatgctattcatcttccgcgaattttacacacgtcacaaaacttgcctgtgatgtgtgggtgtgcgctgtgcacatgtccaagggagatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttc

SEQ ID NO: 6764 - DNA, 995 bp, Homo sapiens
  ENST00000469499
tgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaaggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagt

SEQ ID NO: 6765 - DNA, 787 bp, Homo sapiens
  ENST00000487559
tgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacttcctctcctttcagcaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactcta

SEQ ID NO: 6766 - DNA, 5314 bp, Homo sapiens
  ENST00000366940
ggagggcgagggcgggctcctctggaggcggcgggctccaggccgggctccctaaacgggtcagcaattggagcgggaaggccggacagagacagggtcttgctttgtcacccaggctggagtgcagtgccacaatcagagcttactcctgccttgaactcctgggcttcagggatcctgctgcctcggccctccaagcagctgagactacagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttga

SEQ ID NO: 6767 - DNA, 5365 bp, Homo sapiens
  ENST00000366937
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaaactgatgtaaagttcccatcatgaatgtaattaggaattgtgcatttagatcctgaatgtggcgagaatgtgattggggtcttggagcagtcaagtctgatctggcctgtgttccttcagctaaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccattgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6768 - DNA, 5216 bp, Homo sapiens
  ENST00000408911
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6769 - DNA, 5431 bp, Homo sapiens
  ENST00000360012
tatccacacacagcatcggaatattgctagctaactcaacaaatgtgcaaatcaggggactgttgtgtgtgtaccgattcatgtctatactgtttttattggtgaagtaggaaattagtctaaatatttgattctgcagttgcatgtcaccaaattcagtgaggttagatgttaaatcatcttgttggctttgggctgaatttgatctaagagacaaaagtctcaaacaacagactacttactgccaccacatctcgattcaaagaatagttttcacatgttcgtggtgtggaaaggactttctgtttctcactaatttcttcagctataccaagagtggtgttgtctttgaacaggaaggacagcaaaaataaacataacagttttttcataagatacacagctgcattacacatcccaaaattgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6770 - DNA, 5216 bp, Homo sapiens
  ENST00000361395
agctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6771 - DNA, 5274 bp, Homo sapiens
  ENST00000366938
agctgacaatttactggttcatcaatgaaacaatattaaattatgaagatgtaaggaaaaaatcctacgctaacactgtcgcagtttgaaagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6772 - DNA, 5197 bp, Homo sapiens
  ENST00000359162
ggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6773 - DNA, 5304 bp, Homo sapiens
  ENST00000493603
gagggcgagggcgggctcctctggaggcggcgggctccaggccgggctccctaaacgggtcagcaattggagcgggaaggccggacagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 6774 - DNA, 3359 bp, Homo sapiens
  ENST00000463665
aggtcccactctgtgcttccatggagaagggcggccaatgtgattctgggcaaagtgtggtgacttgtggattttcactgtgacgatgttgctacacggtccttcacttggagttagtgcaacaaggagacatctgagcttaaaatttatgaaacatctaaagaaatcaagctttatataggatcaccgttgtgggttgaattgtgtatccccaaaagatgttgaagtcctgaccacctccctataccttacaatatagccttttacggaagtagggtctttgcagaagatcaagttaagatgaaatcatttgattgggccctagttcaatatatcttatgtccttataaaaggagacaatttggacacagggacaaggggagaatgccacataaagattggaattatgctgccataagccaaggaactccaaagatcgctggcaagctgctaaaagctagcacagattcatggaacagagtctccgtcatagcctacaaaaggaatcaaccctgctgacatcttgatttcagacttctagcctccagaactctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaa

SEQ ID NO: 6775 - DNA, 3015 bp, Homo sapiens
  ENST00000487276
tgacaatttactggttcatcaatgaaacaatattaaattatgaagatgtaaggaaaaaatcctacgctaacactgtcgcagtttgaaaggtccgtgagagaaaagttaattatgatgttatttcaaactttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaag

SEQ ID NO: 6776 - DNA, 2074 bp, Homo sapiens
  ENST00000493748
attctgggcaaagtgtggtgacttgtggattttcactgtgacgatgttgctacacggtccttcacttggagttagtgcaacaaggagacatctgagcttaaaatttatgaaacatctaaagaaatcaagctttatataggatcaccgttgtgggttgaattgtgtatccccaaaagatgttgaagtcctgaccacctccctataccttacaatatagccttttacggaagtagggtctttgcagaagatcaagttaagatgaaatcatttgattgggccctagttcaatatatcttatgtccttataaaaggagacaatttggacacagggacaaggggagaatgccacataaagattggaattatgctgccataagccaaggaactccaaagatcgctggcaagctgctaaaagctagcacagattcatggaacagagtctccgtcatagcctacaaaaggaatcaaccctgctgacatcttgatttcagacttctagcctccagaactagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttc

SEQ ID NO: 6777 - DNA, 1464 bp, Homo sapiens
  ENST00000475275
ctggggtgcacaaataatggttgccggtcgcacatggattcggtagaactttgccttcctgaatctttttccctgcactacgaggaagagtagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcag

SEQ ID NO: 6778 - DNA, 569 bp, Homo sapiens
  ENST00000586199
tcttcacacaggaagtttccttctctgttgtcagatttagcactgtgctcttgtcatcagatccgagccaggctccctgctgcacagtagagaggcttccttaagacatttgtccttgaaactgcaccaaactcttggaagaacccagaacgtagctgacaatttactggttcatcaatgaaacaatattaaattatgaagatgtaaggaaaaaatcctacgctaacactgtcgcagtttgaaagaactgatgtaaagttcccatcatgaatgtaattaggaattgtgcatttagatcctgaatgtggcgagaatgtgattggggtcttggagcagtcaagtctgatctggcctgtgttccttcagctaaaaggagagaacccctggcgagagaggagacaggtctgctgatgaatgcaaacagaaggagcagcatctgtgcatagaggaacgaagcagggtgcgtcttgacagagtacgtggaggtcggcagaagtacaagcgcaggatagatgcggagaacagcccatacctgaaccctcagctggttcagccagccaaaaagccat

SEQ ID NO: 6779 - DNA, 583 bp, Homo sapiens
  ENST00000469486
aactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagatgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtg

SEQ ID NO: 6780 - DNA, 565 bp, Homo sapiens
  ENST00000459955
agtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggact

SEQ ID NO: 6781 - DNA, 584 bp, Homo sapiens
  ENST00000481543
tttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagactggacaacacctgataccaacaatataatgtcacctctgctatagatcacccaagaccagctgcatttacatccagatgttaactactgcagactaagctattaagagtttaacaaatacaagcactggctgagcttcagaccttccatcgaaatgcagaccactttgaacatcagcacgtgcatgtgggaattcaaactcctgacggttcattcacgatcacacatttacctggatgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatg

SEQ ID NO: 6782 - DNA, 548 bp, Homo sapiens
  ENST00000469913
gagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctgggaactgatgtaaagttcccatcatgaatgtaattaggaattgtgcatttagatcctgaatgtggcgag

SEQ ID NO: 6783 - DNA, 519 bp, Homo sapiens
  ENST00000477799
acacaaccagggagcaaatcaaccagcacatttaaagcagcctttttaaccctgagactttccaagatctcctcttcacacaggaagtttccttctctgttgtcagatttagcactgtgctcttgtcatcagatccgagccaggctccctgctgcacagtagagaggcttccttaagacatttgtccttgaaactgcaccaaactcttggaagaacccagaacgtagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataagggtgaaaatatatatgggaaaaattcttccaaaatggagcctgacattgacccctagagcttaaagcctaaccggacagactct

SEQ ID NO: 6784 - DNA, 3171 bp, Homo sapiens
  ENST00000471371
gtgtgtaagatgtgcaatgttcctgcatgggggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggtaaaagtatcattttcctttgggaatcaggtttttctgtcagaggaataaaggcctttctttccaggtcaattcctgttgtgctgaaggctgggaatcatcacgcccttttggtgtgggccccagctttgagcctctgtgatgatggtagaatctggaagtcagaagcccatatcctagatcagctgctttgctgggctgaccttcagtgtgatcctgcatcccaaactcctgacctctccagagaacttggggtgttctcccaagatgctgggcctctgggaagcatctccttaggtgaacagccccagatgcctccttcttaagttggtctgttactccacgctgactatcaacccccaagtgtgaaagatcacgtttattcctgagggaaacacggagttgttcctaactctactttgccttcttagaacacgtttgcttctggttgaaatgaaaattttcagtaaagtgttttggttttttttttctgtattatttttgtttttttatttccttaaacctctgttttgggtgaagcactacagcagaagtctagtgtcatacaaaagtacaactggaatctttgaatgtaaccctcatccaatagcagacatttaaaaaatcactcttataaatgttttaaatgtgttccaaacagcattgacctcctcaataggtaattttgttaaaggactgggctttggctgtttttttttttttttttctgacttgttgatttagagaccagctgcctcctaggaaattgtgatcaaaagctataaaagcagaccataactatgtcaaatgcatgagtaggaattgggaaacttgatttgtcctgtgattcaatctgggttaaagattggtgccacttgaaattactatccttagggaagtcattaacaaccccccaaatgtttgtatgtgcctgtatgcaagtgtatgttgtatatttacaatttcatcccatgttctgtctctccaattttatgattctagctttggtgacctctgactcctccttctctattcctaacactgtgtaacttagagaggatcagggaagctaggatgtcccaaatgcaatttcattaaattaaagagaaatacactaagaagtagaaaaaatgtgatgagtgtgataaaatgatttagtgcaagatggcggatgcagtagagacaaggagcacagagtaggagcttcctgtgcagcagggtgagcagaagtatgcccaggaaagttctgcaaataggtactgtctatcccaggcttaaaaggcaaattagaattagccagatgaaagtgagcaggtaggacaaaaagtgttgcagagggaatagcaaagaacaaagcccatgactcctgagaaagaaaaactatttttatttattttaaacctacaataataactatttctcaaaagggtataggagaagaataattgaaaatatggcagaaagtggaaataaaaggtttgactaattggactatacccttgccctattcttaacttattcactggtttgatatttaattgctctctaagaggatattgactgtctctatgccagtgaattctgcaactaggtagtatgagatctacttgaaaactgtggaattttcagtaggaacatagaaaaattttgaaggaaagaaattctgagaataaaataaaattttattcacttgaattctatttcattgtgagcttaaggaaaaaataaagcttttcaaaaaatgctataatttctctattttctaaattggccctttattctacattgtcctattctcatatatatcagtgattctaaaagtgtggtcctgggaccagcaccatcagcattcacagagagcctgttagaaatgcagatccttaagctccatcccaggcctactgaatcagaaactctgggcatcggacccaacaatctatgcttttacactccctccaggcaattctgatgggtatcaaagtttaagaatcactggtctctactttttttcatgtattttgtacaaaacagtttatattatcttcttattcattacattaattttgtacatatattttctttcaataattaacttttaaattccttatggacaataatcttatctttgtttgtaccagctctatgagttataactgaaatataataaactgcacattacagtatataattggatccattttgacgtacatatacatccatgaaaccaataccttaatcaacgtaataaacggggatctcaccccaaaagttttcttttgctaccttataatccttttctctgacccctttactgacctacttcccccatctcaaggctaatcacttatctgctttttgcctctatggataagtctgcattttgtagactttcatgtaagtggaatcctacagtatatattcttttttatctggtttgtctcaatcagtataattattttaacatatatccatgttgttgaatcagtagttagttcctttttattactgaggtaccatcaaattgtataagctacgatgtgtttattaagttactgtcagtggatttttgtgttattttagcctgggcttttgggggggtcacgaggtcatgagctcgagaccagcctggccaacatggtgaaaccccatctctactaaaaatacaaaaattagctgggcatggtggcacgcacctgtaatcccagctactcaggaggctgaggtaggagaatcacttgaacccaagagacggaggttgcagtgagccaagatcacgccaccgtactccagccagggcaacagagcaagattctgtctaaaaaaaaaaaaaa

SEQ ID NO: 6785 - DNA, 327 bp, Homo sapiens
  ENST00000488947
acacaccgggaatgcaactgagagatgcaagtcagcaagtgcgagccgcgaacatgagtgtctggccctgggtggatgctcctcgctgtcttggtgccgattctctgcctgggcccgagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataag

SEQ ID NO: 6786 - DNA, 321 bp, Homo sapiens
  ENST00000459825
tgcatgggggttttgtagactttcatagccaaagaaaccggcttcggcttctttaaaatccccgacgactcacctgattaacctgctgcagttctgaccctgccaagatgccatctaccttggcagccaacccatatccaacctcagtcttctggatcaaatctaagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattc

SEQ ID NO: 6787 - DNA, 5194 bp, Homo sapiens
  ENST00000616180
atagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 6788 - DNA, 5542 bp, Homo sapiens
  ENST00000391890
aagctccaatcggggctttaagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagtagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 6789 - DNA, 5363 bp, Homo sapiens
  ENST00000361525
aaaggaggcgtgtgtaagatgtgcaatgttcctgcatgggggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 6790 - DNA, 5960 bp, Homo sapiens
  ENST00000251527
agtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagt

SEQ ID NO: 6791 - DNA, 3251 bp, Homo sapiens
  ENST00000275418
agcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaa

SEQ ID NO: 6792 - DNA, 2090 bp, Homo sapiens
  ENST00000435514
tgtgtctttgttaggagatttcataccatgttaatcattatggaaacactacttaagagaatatggctgaaatatgtttgggtttttaaaaatatctttcttacagactaatattgtctgtggacctttctacatttgtttgtttgtttttgaaacagttttgtcacccaggctggagtgcagtggcgcgatatcagctcactgcagccgcctcctcccaggttcaagcgattctcatgcctcagcctcttgagtggctgggactacaggtgcgcgccaccatgcccaactaattttttgtatttttagtagagatgaggtttcaccatgttggccaggctggtctcgaacccctggcctcaggtgatctgagcctcccaaagtgctgaaattacaggcgtgagccaccccacctggcccctttctacattttctaagttcctatctctgaggacaaagggtcaggagcgtagacaacgtagaaaggttctgcagacatgatcctagttatgccagtgtttccaccctgtgttttgcaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatatt

SEQ ID NO: 6793 - DNA, 546 bp, Homo sapiens
  ENST00000483958
atattgcaactggagtaagaatataatgtaaggagcttgggaatgtacagttctgccgatgcgtggtgagcatgagggagtcatatttggagaaccaaggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacg

SEQ ID NO: 6794 - DNA, 663 bp, Homo sapiens
  ENST00000497111
aaaaccctgacaagcagggtgggaagggccccagaggcagcgttctcacgccggaatgcccgataacaagaccgtcccgagagactccgcaaaagccacaaccttgcacactggctaggcaacctcacaccgaaaaataccggaggactcccgccagcggcgcccgtccgacctccggcgggcggcgccctctcacccgtcctcctggccgcaaaatgaccgcaaacagggacgccgccctctcatcccaccgccaccccggctgcgctcagcggccgcgcacccccacgtttgccagcagctcccagaggcggtcagcctttgggtttgacgacggcaacttcccgggcctcggcgagcgcagccacgcacccggaagccgcctcggggcgcgacgccgagccaaaaccgcccgcgggctccgaggccacaggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggca

SEQ ID NO: 6795 - DNA, 2766 bp, Homo sapiens
  ENST00000613624
atgaccgcaaacagggacgccgccctctcatcccaccgccaccccggctgcgctcagcggccgcgcacccccacgtttgccagcagctcccagaggcggtcagcctttgggtttgacgacggcaacttcccgggcctcggcgagcgcagccacgcacccggaagccgcctcggggcgcgacgccgagccaaaaccgcccgcgggctccgaggccacaggcaaaggggcgctggcgcggggctgagccgcccgggatcagcgcgagcacccagcccgcctcggccgggagcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatag

SEQ ID NO: 6796 - DNA, 3874 bp, Homo sapiens
  ENST00000499810
gccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatggggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaata

SEQ ID NO: 6797 - DNA, 3742 bp, Homo sapiens
  ENST00000360541
actcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaag

SEQ ID NO: 6798 - DNA, 1736 bp, Homo sapiens
  ENST00000503014
atagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaa

SEQ ID NO: 6799 - DNA, 933 bp, Homo sapiens
  ENST00000506345
gtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggtatcggtgaaatgcaactacttattctgtgaaatgttttcgtgtgtgtgtgtgtgtgtgtgtgtgtgtgtatgtgtgtgtgtgtatgtacgtgattgtatgtatgagacaaggtaccaaaaatgtaaaaaggaatatttagtatttttattaactcttttgcctcagtaaaagcattattttttatcttctttagtcattaggtcgaataggtgtgtttgtatctactagggaaactttaatatatatcctgttgactgatccctaatcgtaggacgatactttgatgaaatcagccaggacacgggcaagtactgttttggcgttgaagatacactaaaggctttggaaatgggagctgtagaaattct

SEQ ID NO: 6800 - DNA, 745 bp, Homo sapiens
  ENST00000512198
cgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatc

SEQ ID NO: 6801 - DNA, 476 bp, Homo sapiens
  ENST00000503183
aagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcaggtaagtaagaagtagatgctttattatgtaagaccctaggtaggagtaggtgagtcctctgtgtg

SEQ ID NO: 6802 - DNA, 990 bp, Homo sapiens
  ENST00000572514
ggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgt

SEQ ID NO: 6803 - DNA, 713 bp, Homo sapiens
  ENST00000507939
aacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggacgttaaccctctgggcgaagcattgatgaaagctttgataagccaaagtgcccctaaaaccaatgagaacaagaagagaatctgagtgcagaggcccctgggagctttgagggatacattgctcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatgg

SEQ ID NO: 6804 - DNA, 608 bp, Homo sapiens
  ENST00000514005
atgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacagacgttaaccctctgggcgaagcattgatgaaagctttgataagccaaagtgcccctaaaaccaatgagaacaagaagagaatctgagtgcagaggcccctgggagctttgagggatacattgctcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagag

SEQ ID NO: 6805 - DNA, 6123 bp, Homo sapiens
  ENST00000376462
ggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaaacggagatcctggggtcctaaatttgtggccgattgcactgtgtcctggagacggagtggaaccacagcccagagcccctgggaatcatccctgaaagactgcattacttctccatggagtcttcctcctcctgcttattttctttttggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 6806 - DNA, 543 bp, Homo sapiens
  ENST00000481700
ggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagactgtttccttgggccctcggtttaatgctgtccaccacccatgagcaaaactctttctatggcaagaaacatcgaacacctgtagtgg

SEQ ID NO: 6807 - DNA, 649 bp, Homo sapiens
  ENST00000636305
cccagcactttccgtccagctgcacttcatactgtaactgtgtccgttgaaaagtgaagctcaaaggattttttagaatctgctgccccagcaggtaacattctggagttttgttgtttttttttttttcttgttgttttttctgccatttaaaatgtccaaaccctctcgcttggctagacctttcttctctaatgcagcttctaagctgccatcagctaggcgggatgatttgaacagcaaacagaaaaaaaacagcttaggtgagaagattttgagaactgggagtgaaggaaatttggtcaaacagcagcaggtgcaaacggcggcaactcctgcacagcggaaagctacaccacacaaagaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccag

SEQ ID NO: 6808 - DNA, 3203 bp, Homo sapiens
  ENST00000376456
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcag

SEQ ID NO: 6809 - DNA, 7381 bp, Homo sapiens
  ENST00000376454
agcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 6810 - DNA, 568 bp, Homo sapiens
  ENST00000635504
gaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggctttgaagggcatgctgatctctcttcaggcagaacttgacattcaaagacaaggagccccaaactgtctcacagtcctcaaccacccagtctgggtgacccggtcgagcatttatcagagacgtccgctgattctttggaagccatgtctgagggggatgctccaacccctttttccagaggcag

SEQ ID NO: 6811 - DNA, 2589 bp, Homo sapiens
  ENST00000438429
aaaagaaaacagcccagacatggaggggggttttacctgacagctccgaaggaagaccctggagtccgttccagacaaaaacttccagaagaattagattttctgctttaactgccgcctcacctgtggagctctgggtacagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcag

SEQ ID NO: 6812 - DNA, 3281 bp, Homo sapiens
  ENST00000307544
acacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttt

SEQ ID NO: 6813 - DNA, 3059 bp, Homo sapiens
  ENST00000396446
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtga

SEQ ID NO: 6814 - DNA, 5706 bp, Homo sapiens
  ENST00000396445
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 6815 - DNA, 7383 bp, Homo sapiens
  ENST00000376451
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 6816 - DNA, 479 bp, Homo sapiens
  ENST00000460373
acacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactgga

SEQ ID NO: 6817 - DNA, 1358 bp, Homo sapiens
  ENST00000635163
gagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggcatttttggcagttggagaacaaagcaatccaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaag

SEQ ID NO: 6818 - DNA, 1177 bp, Homo sapiens
  ENST00000492009
ccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaaga

SEQ ID NO: 6819 - DNA, 5977 bp, Homo sapiens
  ENST00000458595
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 6820 - DNA, 6052 bp, Homo sapiens
  ENST00000376452
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 6821 - DNA, 5962 bp, Homo sapiens
  ENST00000430453
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 6822 - DNA, 2099 bp, Homo sapiens
  ENST00000296486
acgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaaaaaaaa

SEQ ID NO: 6823 - DNA, 2028 bp, Homo sapiens
  ENST00000411864
gggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaac

SEQ ID NO: 6824 - DNA, 1561 bp, Homo sapiens
  ENST00000512646
aggctcgcgtaggaggcgcgcagaccttgcaccttgcaccttcgcagcgccctgcaccccgccaccatgtgcgagctgtacagtaagcgggacactctggggctgaggaagaagcacatcgggtaagggcaccctggcccggaatgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaa

SEQ ID NO: 6825 - DNA, 1692 bp, Homo sapiens
  ENST00000510706
acgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggtaagggcaccctggcccggaagccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcatttta

SEQ ID NO: 6826 - DNA, 675 bp, Homo sapiens
  ENST00000503912
attgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggtatgttcattatgaagttgtcatgtagttactcatttttttcaaaataataatagtttataggctgggcaacatggtgagaccccgtctctattaaaactacaaaaaattagccaggtgtggtggcacacacaaatagtcccagctactcgggaggctgaggcatgagaatcacttgagcctgggaggcagaggttgcagtgagccgagattgtgccactgc

SEQ ID NO: 6827 - DNA, 680 bp, Homo sapiens
  ENST00000505233
gcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgt

SEQ ID NO: 6828 - DNA, 260 bp, Homo sapiens
  ENST00000511923
gcaacactggttttcatatacttgaaaatatctctcttggaattattttgattactgcttttttttctttgtctcttcagtgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcat

SEQ ID NO: 6829 - DNA, 576 bp, Homo sapiens
  ENST00000509402
gacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcggtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagaga

SEQ ID NO: 6830 - DNA, 567 bp, Homo sapiens
  ENST00000512320
agacaccattccagggatgggagatgggtggaagaaggatagcgctccgccacccccacacaactcgaaagtttttggaaactgtgaactgagaaatattttttcatgatggctccgcaaacaaaccaattctgacaatttttacttaaagtgagctttttcttcttgcatgcttggttaagtgatgaagggtttatctagccaatagaaaaacttgaaaccaccttctgttagaaaagcagagactttatttagatccctcttacccaacttgctctcccaagctgtgttcttcccagcctgcttgtcttgcccccgtcacaaacgacttagtaatataaagtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatc

SEQ ID NO: 6831 - DNA, 543 bp, Homo sapiens
  ENST00000510723
gtgcacgcgccccgcgcgcctccacctgcaggggccgcgcggactcccagaaacgctcctggaacccggaacgctgggcttcctgcccgctcgaaagtccccggctcgctctgcagccggcggactagcgggggctgccggccggctagaggggttggtggatgacggccaatagccctagcagacaccattccagggatgggagatgggtggaagaaggatagcgctccgccacccccacacaactcgaaagtttttggaaactgtgaactgagaaatattttttcatgatggctccgcaaacaaaccaattctgacaatttttacttaaatgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggcca

SEQ ID NO: 6832 - DNA, 5139 bp, Homo sapiens
  ENST00000392668
agttggaaagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataa

SEQ ID NO: 6833 - DNA, 3389 bp, Homo sapiens
  ENST00000526145
ttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaata

SEQ ID NO: 6834 - DNA, 2134 bp, Homo sapiens
  ENST00000531611
ggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatcccttta

SEQ ID NO: 6835 - DNA, 2231 bp, Homo sapiens
  ENST00000319397
gagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagta

SEQ ID NO: 6836 - DNA, 475 bp, Homo sapiens
  ENST00000530924
tgccttagaatatcccagaggataggcacagtgttctctttctagaatttgtttagcaataaaaatgaaccgatccttaagttaatcaaaataaagcacttgacacattttcttccatgcttttgttttatagggaggcctttgtcttttctatctgttcgagctcataacacttcctccgacatgtgcactgtctgttgccttcattttctcctggctggatgggctgagagaagagggatgtgggagtgccgtgtgtggggattagctgcgtagagtgctgaatatctggtgtaatgattcacaatggcttgtgtttctaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaa

SEQ ID NO: 6837 - DNA, 545 bp, Homo sapiens
  ENST00000608978
aactagagctgcttgtgttacttcaggccatggcctttctgggggtcaacagatagcttcattaattagatagatcagattcaacttactggccagtgcccctgatattaagttctggctttgtcagtggggtttgttgtattccctcaaccctatcaccatggctcagtgaccctatttggaataccagcaggactagaagggtagtggtgtaaaacctttaaatgatatgaggcactctgcctttcagtgctttttagataaaggttcatagatcactgaagttaactgcagtcttcactctttctggattgacaggaatagcaccctcaaatttcagagccatcagacaccatggtatcatgctatcggagttgactgttgaaagttgcttaatatccctgatatggaatgtgcagatgtcccactattaactccaagcagcaaagaaatgatgtctcaagcattaaaagctactttcagtggtttcactaaagaacagcaacgactggggatcccaaaagacccccggcagtggacagaaa

SEQ ID NO: 6838 - DNA, 655 bp, Homo sapiens
  ENST00000525404
cagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagatggcaactcaggaagttcctactggtcttgaacactgtgtctcagaattacaaggccagcttagcctgaagtcattgcttaaataacctgctaactggaatgtattgacatgaactgtcaacacggctgctcccttcaaccaattccaagctctttctcctcctaatgagaggcttcttgtgtgtcttgatttggctgttatgcctcttaacattgctcacagtctcaattggatcagaaaacagctttttctagaccacagaatgtatgctattctctgaaatcttaagctcttaagatctctacagtctgtttacccaatgtattgaattcttgtacccaatatctcatgataatgttcatttatgatacatatttcttctcttcttactatttgaataaattatattgactata

SEQ ID NO: 6839 - DNA, 628 bp, Homo sapiens
  ENST00000527676
actcaggatctgctctccggcaaagtagtaagtgaggtgtgctgagagcagaatgagctactttgtggattctgctgggagcagccccgtcccttactcagcgcctcgtcctgcagtggtgtgaaatacggacagataagtttattttatttatttttttctttttcttttttttttttctgtcactcaggctggagtgcagtggcacaatcttggctcactccaacctctatcttctgggttcaagcaattctcctgccttagcctcccaagtagctgggattacagacctgcaccaccacgcctggctaatttttgtatttttagtagagaaggggtttcaccatgttggccaggctggtctcgaactcatgacctcaagtgatctttctttgagatggtctcgctctgttgcccaggctggagtgcagtggtttgatctctgctcactgcaacctgtgcctcccgtgttcaagcgattctcctgcctcagcctcccgagtggctgggattacaggtgcccaccaccacgcccaactaattttttgtatttttagtagagacagagtttcaccatgttggccaggctggtctcaaactcctgacctcgggtgatccatccacctct

SEQ ID NO: 6840 - DNA, 4594 bp, Homo sapiens
  ENST00000535549
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccgggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 6841 - DNA, 6740 bp, Homo sapiens
  ENST00000430479
gtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaat

SEQ ID NO: 6842 - DNA, 4402 bp, Homo sapiens
  ENST00000405192
gagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgac

SEQ ID NO: 6843 - DNA, 4181 bp, Homo sapiens
  ENST00000405358
gactctgcttctagaagcccagtcttcaaaatgagcttacctttcagtgatttggataaggcatagttttgtttttaagacccctttttctgattaaagtgcccaacatgagtggaagaggagatggagggcagcagcagctgctgcactcaaagtttttggctgggtttgtctgccacattgaaaagaatgaaagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaaga

SEQ ID NO: 6844 - DNA, 3363 bp, Homo sapiens
  ENST00000403527
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaa

SEQ ID NO: 6845 - DNA, 3391 bp, Homo sapiens
  ENST00000405218
agtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttc

SEQ ID NO: 6846 - DNA, 2050 bp, Homo sapiens
  ENST00000443137
aagtggcttcagagatgcagccctcactgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggtttttcaaatgttgccctttctgtaattattttaagaggtatatgtctctctactgaccataggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggc

SEQ ID NO: 6847 - DNA, 1603 bp, Homo sapiens
  ENST00000403685
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtg

SEQ ID NO: 6848 - DNA, 536 bp, Homo sapiens
  ENST00000493831
ccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtgagcagctaatacagcattaaaattcattgaaatgttgcacattaatctgaacatcatactttaaacgccacatatcattgcattgctgaagcgagtttttcactcattttaacaaatgcttagctcttggttttggtattacaagcctttctatgtataaatgcctagacattgtagacaaatgtgtagtgatattgtatacagaataataggctttctggaaggtcctactttgctgcacatggttaaaaaagattgttttagtattaatagcacatctgtcttcagaagtttttattgcacattgtctacaattatataattttggaatgcttttgtttatagcaataaagaatctttag

SEQ ID NO: 6849 - DNA, 1296 bp, Homo sapiens
  ENST00000472931
atgtaaaataagtttctttgttttgctgatagtctagttctccaaagagctttttcaatctttatcaatctttaaagttaaatagctttcctaatagtcctttgaaaggatgattgtatttatatgttaatgaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggttagtttaatagattttaattaggacactcagacatgttataacataaagaaactgacacatttgattaatataccaaaaatgtattcttaatcatttcaagactttagggaaactttctgaattaaaaagcatgcaaagataaaacatgtctacctttaaaatcaccaatgtattgcgtgttccttccggttgtatacaatcctacaaaattgatgttggagaaaattaa

SEQ ID NO: 6850 - DNA, 1141 bp, Homo sapiens
  ENST00000438956
agtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatg

SEQ ID NO: 6851 - DNA, 848 bp, Homo sapiens
  ENST00000476720
cttgaatgcagttgatcaagttgctgttagcatgtaaaataagtttctttgttttgctgatagtctagttctccaaagagctttttcaatctttatcaatctttaaagttaaatagctttcctaatagtcctttgaaaggatgattgtatttatatgttaatgaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcag

SEQ ID NO: 6852 - DNA, 784 bp, Homo sapiens
  ENST00000443608
aaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttat

SEQ ID NO: 6853 - DNA, 584 bp, Homo sapiens
  ENST00000497115
aaggaagatttcagtgaacagacacatattcacctcagcctttttgtgaattctgaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccc

SEQ ID NO: 6854 - DNA, 846 bp, Homo sapiens
  ENST00000476355
gttttaatctagcattgaaccagcctaaaaacaactttaagtgtaaatgcttcaggttgttttgatgctgagataccatgaatatatgattgataaatagtaatgtgctaagatcggcactgggaagcaactctccctgcctgcttaacataagctttcactgtcaaataagtgagaaaatgaatattagagttgatactatggacttctatttttctattcagagaagatccattagacttatgtatgcatgtctgtgtgtgtgtgtgtgcgcgcgcgtgtgcgtgtgtgtgatctgaggtttacattcttttaaaggattttatctttccctttgtagagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggacca

SEQ ID NO: 6855 - DNA, 554 bp, Homo sapiens
  ENST00000421381
cgttattggctgcgggaagaacctcgccgggacctaacccgaagctccgccccctcgcggttaccctggatacccgtcaggctcgggctgcagagaaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcc

SEQ ID NO: 6856 - DNA, 580 bp, Homo sapiens
  ENST00000431887
aagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccat

SEQ ID NO: 6857 - DNA, 570 bp, Homo sapiens
  ENST00000460438
taaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttcaagatcaacacagattggagtacttgagaaagacttcatgaagaaaatgaagcctgacttacaacagaatgagaaatctactcaatgaaatattagaaatgacaggaacctggagataattcacccaatatctctgtgtttgttggataataatagctaatacttgtgtaatgctcacgatgtgctagttcctcttctaaacactttataaatatcttaatgcagccaatcttcataacatccttatttagtagaaactattatctctttcttttggtgagaa

SEQ ID NO: 6858 - DNA, 622 bp, Homo sapiens
  ENST00000483075
agtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacagctttgaacagcgatgtcttccacattgttgtctccagcctggttcttccctccgaagctgtccattggacatcctcacctgatccctgctagtgtccctgtgcagattagaaaaaggcaacacctctggacttgctcccttagcccttggctgtgcattgcacaaaacaccatctaca

SEQ ID NO: 6859 - DNA, 546 bp, Homo sapiens
  ENST00000433547
agaggcgctttcggcttccaagggggaagtgctgggctataattaatgtttttattaaatttggagggaagtttttgcagcctttcgcctagcgtggccttcaggtgggtctttccaacaactttttatgtctctccagataattgcatggttgtgggtcgcaaaaactatcctgatgaaagaggtgtctccgtctctttagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggaga

SEQ ID NO: 6860 - DNA, 550 bp, Homo sapiens
  ENST00000485475
gatatacgagcaaccccaagcactccctcctcctccccacagccacagtggactggaagtaccttttcccagtgcacacgctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaa

SEQ ID NO: 6861 - DNA, 6231 bp, Homo sapiens
  ENST00000420159
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 6862 - DNA, 6348 bp, Homo sapiens
  ENST00000242066
cgttattggctgcgggaagaacctcgccgggacctaacccgaagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 6863 - DNA, 6096 bp, Homo sapiens
  ENST00000399357
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 6864 - DNA, 1539 bp, Homo sapiens
  ENST00000326786
gggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtaagatacaaactcttttggtagggaattaattttgaattgaaaagaatttttaaaaatccaaatctaagacatggcatgtttaggaagattttagaaacactaaaataatgtgatcctttggattgcctcaatgttcttactcaagtcatctcacttataaggagagttataggctattcagtatcaagatagatttctttggtttatttggttggttcccttttctgcatattgtttgtaatctcctagatactattacgctatcttgtttgggaatgatgtttcataggtttgtgatgatctttacgttcaggactcagttttaacacccagcccagtggttctttcatagatgggaacctgtttctacaaacacttccgattttctgtgaaactaccaagctctcccttatcaagtgaatatcatcaaaaccacagcatccttgatcagagaagggggaggttcacatgtttgcagtgaaaagcagtgtctttgatctgcaacagcaaatcctcagagaaaaagattctggggttacttgaccttctctcctgttaagtgcagtagggcttcccctcttgactttcctggttatagctttccatcacagctccccacattctctcttgatgttgaaagcagtctctcaaaagactttgttgttgtgtggttttttgtttgtgatttttttccttatgcaaatcatactcctgcccaagaaaatacagtagttccccttatctgagcagtatatgttctaagacccctagtagattcgcaaaccacagatagtaccaaactccattcatatatatgatgttttttcttcccttaaccccactcatatgtatctgtgataacgtttaatttataaattaggcacagtaagagattaatgacaataataaaatagaaaaattataacaatatgctgtaataaacttaatgtggtctttctcaaaa

SEQ ID NO: 6865 - DNA, 696 bp, Homo sapiens
  ENST00000460850
acggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcaggtaaggaaaaggattcccaaatctgtgttaacagattggaaggagactaagctgtttggtgaatgctagataaaaagggtatcaggtaataaaagactacactatcttagtgaataatgtgtcactttaaagtgggagtagaagagctgttgaatgtgagtagcataggcacaggaggagaaaaggcatatctttggttatacgtaggaggggattccaatgtggctggcactggatcctgacagacagctgattctgctctgtagtgggcgagagtatatggtgaaacatggattggagttcatttataatccaaaggattagtttagacttctctattagaatctgttagaatttctttctttgggcttccctgaaa

SEQ ID NO: 6866 - DNA, 5254 bp, Homo sapiens
  ENST00000368192
ccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtgtggttcctcagagtgcaccaccagtgccaacagcctcttcccggttccatttcccacctctggacacccattctccaaccaatgatgtgcagccgggacggttctctgctagctccctaactgcttctggccaggagtccagtaatggtactgatagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtccccatttcaccagccctctccctgactcccaccatcttctcctatagcccatcaccaggcctgagccctttcaccagcagcagctgcttctccttcaaccctgaggaaatgaaacactaccttcattctcaagcttgttctgtgttcaactaccatctgagtcctcggacttttccccgttacccagggctcatggttccaccactgcagtgccaaatgcatcctgaggagtcaactcagttctccatcaagctgcagcccccaccagttgggcggaagaaccgggagagggttgagagcagcgaggagtcagcaccagtcaccacgcccaccatggcttctattcccccaagaatcaaggtggaacctgcctctgaaaaggatcctgagagcctcaggcagtcggcacgagagaaggaggagcacactcaagaagagggcactgtgccaagcaggaccattgaagaggaaaaaggcaccatctttgcccgtcctgctgcaccacccatctggccctctgtgcccattagcaccccaagtggagaacctctggaggtgactgaagacagtgaggataggcctggcaaagagcccagtgcacctgagaagaaagaagatgcactgatgccccccaagcttcggttgaagcggcgctggaatgatgaccctgaagcccgagagctgagcaagagtggcaagtttctctggaatgggtcaggaccccagggcttggcaacagcagctgctgatgcttagaactggaagtggattaggagctgtttatactataatcaaatacatacatgtatttatgtagcaagatttcagggtgggggggagggagttaaactggtttgatcattctaggggcatagacttgtatttttatgttttggggatgggatggggttatcttctgttgtaaattaggtgggatatgaacacacttattttcctggtgagtaggacacagggagggtattgaactcaaaggagaaggagcctctatttcctgttgaggcttatactttctgacaaggaaactcccaaagggccaagatactttttggtcccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaa

SEQ ID NO: 6867 - DNA, 2429 bp, Homo sapiens
  ENST00000319349
gaaacaaagggaaacggggggcggtgtggcggggcggggggtggagagctgaggccgagcgaaggaaatgcaccaatcagctgctcccccgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 6868 - DNA, 2182 bp, Homo sapiens
  ENST00000393664
caggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctccca

SEQ ID NO: 6869 - DNA, 1775 bp, Homo sapiens
  ENST00000545954
gcgcccgaaaaacaagtcggtgcgctggggacccggggccggggccgccttactccggcctagccccgcggccctcggtgcgggctccagggcatgctcgggaccccccgcggctccagcccagacgccccggcctcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctgg

SEQ ID NO: 6870 - DNA, 1628 bp, Homo sapiens
  ENST00000545089
agccctccctggacggtgtgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccct

SEQ ID NO: 6871 - DNA, 1727 bp, Homo sapiens
  ENST00000591713
gcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagt

SEQ ID NO: 6872 - DNA, 917 bp, Homo sapiens
  ENST00000586826
cttgcccagcccccgctgctgccttccatggcctcagccgcagccctcaagttgaggaggggttccagcatcacactccctctgggtgaactttccctgggattttgtggttggcaggcaacctgggcaaagaacagtcaccaggaagcaggctggaaggaagaaattcttgaatgtggataggacttcctcctcccctgccctcgagctccaccccaagccacttctcacatcaccccttcttcccccacagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccc

SEQ ID NO: 6873 - DNA, 616 bp, Homo sapiens
  ENST00000590236
gggtgactcgcgggcattctccccgcttctcgcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaaatccaactaccctggaactctccatagaagctcggagtaaaaagaaaatgacccctgactagatccttggagtgagactagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttc

SEQ ID NO: 6874 - DNA, 760 bp, Homo sapiens
  ENST00000585508
aaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcgtgagcgccgcgccggcctccacgcccgccccgccccgcacccagcccctactctcaccacagcccccctccccgcagtcccagcggagtcctgggctgccccgcccctgagtcacccgaggaccccaacctcgtcccccagactaagcgcctcagggtgactcgcgggcattctccccgcttctcgcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcct

SEQ ID NO: 6875 - DNA, 582 bp, Homo sapiens
  ENST00000587151
atgcgatggtgtgcgcttcgcctgctcctccgcgcgcgcgcgcgtacacacacacacacacacacacacacacacacacacacacacacacgttcttatgtaaccgagcccgggtaaagcagggctgcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaaccgtgagtagaggtccctggggagagggtatagggagtggaggatggcaggaagtgagtcataggatagagaatcacaagagagcagcttgttctctcctaaaacacagtgg

SEQ ID NO: 6876 - DNA, 581 bp, Homo sapiens
  ENST00000586764
aaggaagcagtgaggggaacagacgagctccacacacaaagggacgggaggagagggatagacacaaagcctgctagaggtgatcagggaaggcttcacagaggaggcagtatcagtcccagcaactgtagcccagttgctccccgtcacccaaagacagccacacctgatcccctggctcaggcagctggaaagaggagctgagaaaaaggagagtcatgctctcagcaaacatcaagtgctgtaagcatcataaaatcatcatcatcatcatcaccatcagacactgatggcccagtgggaggcctgggaccctgaagagagcccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaa

SEQ ID NO: 6877 - DNA, 2147 bp, Homo sapiens
  ENST00000538265
cacgttcttatgtaaccgagcccgggtaaagcagggctgcagaaagcagaaacggcgagcccggctcctgggagcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 6878 - DNA, 4111 bp, Homo sapiens
  ENST00000306376
agcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaa

SEQ ID NO: 6879 - DNA, 2213 bp, Homo sapiens
  ENST00000434744
ggagcgcgagtgcgggggctcccgagtggatgggggatcgcggagttgcgaggctttcacagtctctggagattcgagagccccgaggggacttggaggctcgcgagaagagacgcttggcggagctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaa

SEQ ID NO: 6880 - DNA, 764 bp, Homo sapiens
  ENST00000480706
accacagagctgcagttgaccgatgtgctgtttctgctgcagaaactattgacaggattgtgtccacctttgctttcctttcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaac

SEQ ID NO: 6881 - DNA, 366 bp, Homo sapiens
  ENST00000433149
tgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatg

SEQ ID NO: 6882 - DNA, 614 bp, Homo sapiens
  ENST00000489830
gcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtaaggaacctgcttttctttcctcttctctcctctctcctctcctttcttcctttctttctctcggcttttctttctcctaccttccttccttcctctttctttgcttgactaatacccaagcttaaaattgctcagtttccaggctaagatttgagatcatagtttaaaccttgcttagctcatgaatatgagagctgattg

SEQ ID NO: 6883 - DNA, 590 bp, Homo sapiens
  ENST00000484223
tttatttcaagtttctctgggataggggggtagttgtcaacaatattaccaaaggatgcaagatggtggccatggggcttatgtaacatactgtattaacagttaactgagttgggagacaaatatcctagttctcctggagaattgggagatgggtagccccagtctcagctgtgaaataagcctgtctccagtccacccagccccctgagaaggaaggagttttggattcctgggattgatgagttatttgcccgtgggtgttgaaaggaagagaggagggaaccagaatgcagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagg

SEQ ID NO: 6884 - DNA, 238 bp, Homo sapiens
  ENST00000472868
gaggatcccttttcccccagaaattactcaatgctgaaacctctcaaagtggtattagagacgctgaaagcaccatggacgggttttatgatcagcaagtcccttttatggtcccagggcacaagttcctgatgatgaacagtttgtcccagattttcagtctgataaccatttcagagacaactgtctgaaccctgccaccccttccctcctcagccaggagttcctggagataatc

SEQ ID NO: 6885 - DNA, 574 bp, Homo sapiens
  ENST00000440773
agcatccccggagagaagatagagccgccccacggccttcacaggagggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctattt

SEQ ID NO: 6886 - DNA, 554 bp, Homo sapiens
  ENST00000421809
gtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaaccccc

SEQ ID NO: 6887 - DNA, 573 bp, Homo sapiens
  ENST00000413301
tttgcgggggcaggggggagatcggaaggggcgtccggccactggtccgacaggcccagccggctagagttcacgggctgattcagaatcttcaaagtcggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagc

SEQ ID NO: 6888 - DNA, 564 bp, Homo sapiens
  ENST00000422039
ctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacccatttcttttcaaacttcctcaagagttcatgatcccttttcaattccaatttgttgccatcctttatagtcctgggtctctgtcatcatttagcaagtcagctgtgcaaagtggtgcttcatgccccacctccaaccaagatcaaacgggagctgcacagccc

SEQ ID NO: 6889 - DNA, 642 bp, Homo sapiens
  ENST00000476890
gccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataaccgaaaaatgtcctgtttccccttatcctgattgcgtgatccagtgtgagcagcccttcatgataaaatccactgtggttgatgtaaggtcacagtagaggaagccgccctgtcatctctaatgagttgggagaacaagggtttccttagacctctttctcaatcttgaaaataaaaccaatagttgtctatcata

SEQ ID NO: 6890 - DNA, 472 bp, Homo sapiens
  ENST00000475484
ttcaggatctcagtcaacttcaagaggcttggttagctgaagcacaagttcctgatgatgaacagtttgtcccagattttcagtctgataaccgtaagtacctttctggtgatggcacatttgttctgaaattgtttggtcttagatcatccatgtctagaatatgcttttttcagctatggccagatttagacagtagtatgcatttagtttcttctaataattcagaattaaccctgaaaacttttatttcataataaaattatttctaaagtatttctactgtattgcaggtaagatttactgaacataattttatcctaaatttctttttaccttaagaatattgtaaagctgactgggcacagtggctcacacctataatcccagggctttgggaggctgaggcaggtggatcacttgaggtcaggcattcaagaccagcctggccaatatggtgaaaccccgtctc

SEQ ID NO: 6891 - DNA, 187 bp, Homo sapiens
  ENST00000495808
ggcctctttcagaaatctcgatctgaggaatgcagagggcggcctgtgattgacagaaagaggaagtttttggacacagatctggctcacgattctgaagagctatttcaggatctcagtcaacttcaagaggcttggttagctgaaggcaagtttcatggatgtcctattttccatataaaacatt

SEQ ID NO: 6892 - DNA, 589 bp, Homo sapiens
  ENST00000490746
gcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcaggtgtgtctttgagaagatgagaagatcgcagacctgtattctaaactggaatggttctaaagaaaaggt

SEQ ID NO: 6893 - DNA, 479 bp, Homo sapiens
  ENST00000485891
gactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcaggtgtgtctttgagaagatgagaagatcgcagacctgtattctaaactggaatggttctaaagaaaaggt

SEQ ID NO: 6894 - DNA, 1802 bp, Homo sapiens
  ENST00000393913
cggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 6895 - DNA, 1747 bp, Homo sapiens
  ENST00000410113
ctgactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagtgcaggtaggtagatcgctgaccacatttgctcatttctggattattcattcaaaggaagcactatgagtcaatcattgggcacagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctc

SEQ ID NO: 6896 - DNA, 696 bp, Homo sapiens
  ENST00000410010
attctcagtaaagacacactacgtaatcaaagctactgctctgctttgctgagctttgagatgaaaggtctccaggttgggagttaagcttgtcattctctaatttgaaaaatgaagggttctaagagctttgtcttgcagaaaatgtttagctgctcaaaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggc

SEQ ID NO: 6897 - DNA, 777 bp, Homo sapiens
  ENST00000410071
cgggacaggaatgagaggatggatgctggcaggggcttggagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaaccca

SEQ ID NO: 6898 - DNA, 569 bp, Homo sapiens
  ENST00000432649
gagtagctgaatacaggctcaaagcaggcgacgggacaggaatgagaggatggatgctggcaggggcttggagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcc

SEQ ID NO: 6899 - DNA, 434 bp, Homo sapiens
  ENST00000452003
gaacccgatgggctgtgcctcaaaggtgaaccagggagaatcaaataaagagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgc

SEQ ID NO: 6900 - DNA, 585 bp, Homo sapiens
  ENST00000486696
aaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagtgcaggtaggtagatcgctgaccacatttgctcatttctggattattcattcaaaggaagcactatgagtcaatcattgggcacagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctc

SEQ ID NO: 6901 - DNA, 524 bp, Homo sapiens
  ENST00000486489
ctgaatacaggctcaaagcaggcgacgggacaggaatgagaggatggatgctggcaggggcttggagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaaggtcctgactttttggaatgcccttcttcctccttggctggcaatcaatctttgagactagaagttaagtctccttttgggtgaagcatcattcttcagttcctacagaccattttgttgctccctgccctgccccaggttgggggaaagcctcagcctcagcctcagcctcccctctcccctccttttttttaaaaaataaatatgtatctcttgca

SEQ ID NO: 6902 - DNA, 1815 bp, Homo sapiens
  ENST00000233712
agcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 6903 - DNA, 887 bp, Homo sapiens
  ENST00000316052
acctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 6904 - DNA, 606 bp, Homo sapiens
  ENST00000525936
gggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgc

SEQ ID NO: 6905 - DNA, 1065 bp, Homo sapiens
  ENST00000527954
tgcttagcgcatgagtgtgggagctctgctttccaggcggagggaaccagaagggcgaagaccacggtggtgaaaacaagcaaggcacttatgcagagcagaaagactgctggtggggaaagaggggataactccaaatcaggttgagggttcccggggaggtgaggacttagggttttgtagagtagggaaatgatttgggatcttatttcatatgtaatgtgaaacctttgtaaggtagttaggatttgagtgtgtaggtgagacagaagcagcgttgatgtttgtaaacttgggttggcagggaatggggcaaggatggacacaaggaagccaattaaaaggtgccagagggcgacacatgcaagacagagagcgcaaaacagggggctttgttttggaggtaacgcagttgccccttgctgaggcattgaaagtggagggagaggcagacccacagaggacagtggagtgtgagctggaaggagtgggcctggctcatgtgtctgtcctcttccagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 6906 - DNA, 10187 bp, Homo sapiens
  ENST00000265843
attattggctgtgggatcaagttcgtgaaactggtcttgtacaggttgaaaaatgccttcctaacaggaggcgccaaggagcttaagtgtaactcacacacagtaaagaaaatgacgaaagttcctccggcgtttgatttcagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaagataaaggaattttgtaagtacttcctgttatatccgtagtggagcctgggaggcacatggtcaaagcacatgttgaggttatagattaggacctgaatccctagtaagccaatagaaggttagcagtcctagaaattcctctgaaaccgtgggggactggctggattattaagggcttttagtcaagccaaggacttaggccaggcaacctgaccatacagaaagttgcctggtcacagaatttctgcttatgaagagaacatagctgaggagcagaggtaggaagtaggtatcccttcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagcctccagagtagctgggatcacaggcgcacccaggcgcacgctgccacgcccagctaatatttttgtattttagtagagacggggtttcaccgtgttgcccaggctggtctcgaactcctgagctcaggcaatccgcccacttcagcctcccagagtgctaggattacaggcatgagctaccatgcccagtctttttttgttttgttttgtttttgtttttgttttgaggtggagtcttgttcttgttgctcaggctagagtgcaatggcatgatctcagcttactgcaacctcctcctcccaagttcaggcaattctcctgcctcagcctcccaagtagctgggactacaggcacccaccaccacacctggctaatttttttttttttttttttttttttggtatttttagtagagttggagtttcaccaggttggccaggctggtctcaaacttctgacctcaggtgatctgcccacctcggcctcccaaactgctgggattacaggcatgagccaccgtgcctggcccacattttctttaattgcaaggtagaacgcttcttttcaggtggggcattttagtcccaaatatcaagtgggaaccttggccaagtccctaaaatgccatcaagtcagatctgacaccctggaattcattctttgctgcaggatcatctacgaaacccttgggaaattctaaggcagagctcctaagggcttgtcactatgattcagtgatttatctagagtaaatcacttatgatacccactgatattttggctttcctaactctttatttgccatgcagaacctcgggggatttctctcctaattcaggataaagaccaatagatggcagtgaagataatctgctttaactacagacagcatggattcctggatctcaatactatgatagtcaacatgagtggattttatcttgcttggtttatatttgcttcgcgacctaatctaattttccattttttatacctagtctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagatgca

SEQ ID NO: 6907 - DNA, 6542 bp, Homo sapiens
  ENST00000525344
gaaacatgtcattaagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaagg

SEQ ID NO: 6908 - DNA, 5495 bp, Homo sapiens
  ENST00000526312
gataaagctactggtgcagccactgaaccacagggctttctcttccttcactctgcctctttctgattgggaacacacaacagttgttttaaagctttccctggagggtgagtgataagaaacctattacctggaagtatcgcctttctaaagtaggagaacaaaaggccacactttccccagatgcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaa

SEQ ID NO: 6909 - DNA, 3893 bp, Homo sapiens
  ENST00000533052
aaataaaaggtgttggaggtcactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaa

SEQ ID NO: 6910 - DNA, 1882 bp, Homo sapiens
  ENST00000524840
cactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgag

SEQ ID NO: 6911 - DNA, 555 bp, Homo sapiens
  ENST00000531386
agtaacaagctggctttcaccggcaccctcccctttggtacggggtcagcagaagggtgttttgtcttcagcgagtcggaaaccccctgtcttcagtgtattctgcccaccaggatagggcactgtggattttggttttgaagcttgtccagagtcactcaagagagacaaagcggccattctactgtgtgctacccaacacccaccagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacct

SEQ ID NO: 6912 - DNA, 2835 bp, Homo sapiens
  ENST00000370113
cactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 6913 - DNA, 3985 bp, Homo sapiens
  ENST00000370114
gggcgggatgagaaaggtgctggagctgttggagggacgccaggaggtggcaactaccagggggtgtgaggggctgacctgggatggaatcctgccacccggactcaggaagaaaatcctgaggtggcgacctgcagactgggctgggagatggagagcccgctcacgcccacccgaccgcctaccaccagtgttcccggatgcatgggctccagcgcctgccctttcgccatttcctcccaactggcattaaatcctggtgtggtagatatcagtgattaagagtctaggcagccacgtgttctattgccgccagtccgcaggaaacgcaagtgatcgttttgctgcgttaactctatgggcgcccaaatcttaggaatccattccacgccaccccgaaaacagcgcttgacccttctggactgccacgcaggaggcgatcaatgtttttctttctttatttttttaagagacaaggtctcgccctgtcacctaggctggagcacaatgaggctcactacagcctggaactcccggacgcaagtgatcctcctcagcctccggagtagctgagacctcaggcgtgcgccaccatgcctggcatcaatcaatgtctttcaaaataaaggctgttaaacgtagtataggaaagaagctttttaatggtaggttctaccagacgtgtttgtttgatttttaggtttggttaatgcattgtttcccgtacaatctcaacccgcggaaaccccgaaactctagaattcgtgccggtctctttcgcttccaggtcatccccggggcaacggccgccgctctaattcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacgtgaatgtttaaaagttgttaccttggagaagaaatggaggaaaggattggctttcggaggtgggctggaaactacaaaaccgagcttcctgggaatgccttttaggccgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcca

SEQ ID NO: 6914 - DNA, 902 bp, Homo sapiens
  ENST00000450240
ggctggccctactgcaatctactgcactcgagtgacaagtgagcctgcttctgtcaattactgaagctataaggagattttttaaaaattaaacttcaacacaatgagaacctggaacagtggtggcacaaagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaaga

SEQ ID NO: 6915 - DNA, 730 bp, Homo sapiens
  ENST00000416479
actttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgagaacctggaacagtggtggcacaaagtaagtgctcaggaactatctgttgaatgagtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacagg

SEQ ID NO: 6916 - DNA, 440 bp, Homo sapiens
  ENST00000494907
ctgcagggaaataaatcggctggccctactgcaatctactgcactcgagtgacaagtgagcctgcttctgtcaattactgaagctataaggagattttttaaaaattaaacttcaacacaatgagatttgtgaaaaaagtaacaggaattaagaagaacctcgtaagaatagaagagctacttaggaaaaagggaggggaaatcattttggaaggagagcatagaattggtagaaaatgagaaaagctgtatggcatttctaaaacaacaatgaaaagaatgactttcctgaatgtgggtaaaaaccttacatcaaaaactcttccccgaatcttgtatagcacctggaaaagacttgtgaagaaaaatgacctttcatgtaccatttctggcattttgtattttgcaatgcaataaattctagtttatgctgcttataa

SEQ ID NO: 6917 - DNA, 678 bp, Homo sapiens
  ENST00000480774
cgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgaggtaagtaccaatattttttggcttttgtttaactgttgtaaaatacgtataacacaaaatttatcaccttaacgggttttaagtatatagttcagtagtgttaactgttttcacattgttgtgcggccgatctctggaactttttcatcttgcaaaactgaaactttatacccactgaacaacaactgtccatttcttcctactcccagcccctggcaactgccattctttctgtttctataaatttgactttcctaggtacctcataataaatggaatcatacagtatttgtctttttgtgactgcttatttcaattaacataatgtcttcaagattcatctatgttgtggcatgtatcagaattccctaatttgtaaaaacagaataataatactcttttgtacctgtgtatcatattttctaaatg

SEQ ID NO: 6918 - DNA, 3146 bp, Homo sapiens
  ENST00000535414
tcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacgtgaatgtttaaaagttgttaccttggagaagaaatggaggaaaggattggctttcggaggtgggctggaaactacaaaaccgagcttcctgggaatgccttttaggccgacaggaagtggagcgtcaccgaaagggaggggcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatccatgtgttctgtgttaa

SEQ ID NO: 6919 - DNA, 3907 bp, Homo sapiens
  ENST00000388742
gagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 6920 - DNA, 3743 bp, Homo sapiens
  ENST00000465115
aaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaatttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 6921 - DNA, 4326 bp, Homo sapiens
  ENST00000340726
aaaccaataaggttaggacaagagaatagctgtggtttgcgttgcaaaaaccaaaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 6922 - DNA, 3930 bp, Homo sapiens
  ENST00000303824
cgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgta

SEQ ID NO: 6923 - DNA, 3404 bp, Homo sapiens
  ENST00000388741
gggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctc

SEQ ID NO: 6924 - DNA, 2199 bp, Homo sapiens
  ENST00000388743
gagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaaaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactaca

SEQ ID NO: 6925 - DNA, 2373 bp, Homo sapiens
  ENST00000496494
ctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaagtaagatgtattttctcttaatcaataaataacttctctgagtagacttttatttatttaaagtcatgtctgtgcccacatgttccatcttaatttaaatgaaagtgcatttcatagagatgtaaacatattgatacaaatttattttgagcatcatgtagtggagacactgaagtatttcagtgctttgtcaattctgtgtgaaagttttactttaagatacaatatttagctggaatttgtgatgtggttgttaatcggtttgcatgtttccatctaatgcatgggctttctattttctgtcatttctgacaaatagcagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaa

SEQ ID NO: 6926 - DNA, 1723 bp, Homo sapiens
  ENST00000419131
atgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgaca

SEQ ID NO: 6927 - DNA, 879 bp, Homo sapiens
  ENST00000493349
ttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagagtcaagggcttccagagagtccatgatgctggtgaagctgggcagaagaaagcctagcagcgcttgagctcttcatgaggtctatttgaaagcacagtgagggcttggacgtgcccttagaaagcacaatggaatcatgctgttctgcatcagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtga

SEQ ID NO: 6928 - DNA, 440 bp, Homo sapiens
  ENST00000422295
attcattcctctttatagtttaactttctgttaggtggaaccatatgaaatttccatctccgcaggtcacaaagaccaaatatctgaaatttcatatggccaacctatagttgaaaatatgtcagtgctttctatatattttgtgttttgcttggattattgtgcattattttgttttgtttttgttttccagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaagg

SEQ ID NO: 6929 - DNA, 3788 bp, Homo sapiens
  ENST00000388740
aaacaacagttgagacctcaacttaaagacaatatgcctttcactgctgcagtatcctcctttttctcttttggttaaaagagagcattgtcgttctcagccatgtgctctgtataattaagagctgacactgaagcagagtaacaacatcttctaatttttttacccctgatcacaggtgcaaacatctcaagccagttcagatgttgctgtttcctcaagttgcagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgt

SEQ ID NO: 6930 - DNA, 10589 bp, Homo sapiens
  ENST00000503581
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaaccatattgtattacatggcttagctacaacttatttatatgattcaacaatgtaaaacttgaacatagatttaaaccaaaaattattgcatgaatgtagaaagagaaggtgagaggagaggagaacaggctggtaagagctaaatccttatctttt

SEQ ID NO: 6931 - DNA, 10485 bp, Homo sapiens
  ENST00000370621
gatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccagatgcctgtaccagtcaagaattttactggctgcatagaagttatagaaataaataactggagatctttcattccatccaaggcagtgaaaaactatcacattaacaattgcagatcccagggatttatgctgtctccaacagcctcctttgttgatgcttctgatgtgacacaaggggttgataccatgtggacttctgtcagcccctctgttgcagcaccctctgtgtgccagcaggatgtatgccacaatggaggcacatgccatgccatcttcctctccagtggcatagtgtcattccaatgtgactgtccactacatttcactggccgcttctgtgaaaaagatgcaggtttattctttccatctttcaatgggaattcctatttagaactgccctttttgaagtttgtcctggagaaggaacataacagaactgttaccatctacttgactataaaaacaaacagtttaaatggaactattctttacagtaatgggaataattgtggaaagcagtttcttcatttatttcttgtggaaggaaggccatcagttaaatatgggtgtggaaattctcaaaatattttgactgtttctgctaattacagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagcacttatcctcattgtgatcttggaaaagccaaaaccagcagaacggaaagtgaagaaggaggctttatccataagtgatccatctttcagaagcaatgagttatcctggatgtcttttgcttcctttcatgttcgaaaaaagacacatattcaattgcagtttcagcctctcgctgcagatggtatcctattttatgctgcacaacacttaaaagcccaatcaggtgattttttatgcatctctttagtaaatagttccgttcaacttcgctacaaccttggcgacagaactatcattctagaaactctccaaaaagtaactataaacggaagtacttggcatataataaaagcaggaagagttggtgcagaaggctacctggatctagatgggataaatgtaacagaaaaggcctccactaaaatgagttctctggacacaaatacagacttctatattggaggagtatcttctttaaatcttgtaaatcccatggcaatagaaaatgaacctgtaggttttcaaggctgtatccgacaagttatcataaataatcaagaattacaattaactgaatttggagcaaaaggtggctcaaatgtaggtgactgtgatgggacagcctgtgggtacaacacatgcagaaatggaggtgaatgtacagtaaatggcacaactttttcttgcagatgtttgccagattgggctggaaatacatgtaaccagtctgtgtcctgtttgaataatctttgcctccaccaatctttatgtatacctgaccaatcattttcttacagttgcctgtgtactttgggttgggtgggaaggtattgtgaaaacaaaacttcattttcaactgcaaaatttatgggtaattcttacattaaatacattgatccaaattatagaatgagaaacctccagttcactactatatccttaaatttcagtaccactaaaacagaaggtctaattgtatggatgggaatagctcaaaatgaagaaaatgattttctggcaattggtctccataatcagaccttgaaaatagcagttaacttgggagaaagaatctctgtgcctatgagctataacaatggcacattctgttgtaataaatggcaccatgtagttgtaattcaaaatcagactcttatcaaggcctacataaataacagtctaattctttccgaggatattgatccacataaaaactttgtggctctaaactatgatggcatttgttatctagggggctttgaatatggtagaaaggtaaatatcgttactcaagagatttttaaaaccaattttgttggcaaaattaaagatgttgtattttttcaggaaccaaaaaacattgaactaattaaattagaaggatacaatgtttatgatggagatgaacaaaatgaggttacataagttaacactagagattttagtacacactatacataaatgcagttattttgatagttatttctttgatacattgcttacggggaatcaactgtttactatattacctgaaatagtctaaatgctaacatatctttttgataagattgtaaaatgtcactgaaggttctgattgtttttcctacatctaatttatctgtatatattttgattcatgttttaactccattagttcagtgcttattcacagaatgtgcttattcactttgcttattcactttttacctatccctaatgcttacattttaaaatcaacgtgtaaacacaattttaaaaatcaatgtgtaagctgaactttaaaatgtttaaaattcagttgggaatgaattagggataggtacaaataagaaaaaaatcaagttattaatcaaaggaaaaataaaaattatacaaagcaatgtaa

SEQ ID NO: 6932 - DNA, 2295 bp, Homo sapiens
  ENST00000398580
cagcattaacacaaatgcattcacccctatcacaatacgctacacaacgcctgttggcagccctggagttgtttgtatgattgaaatgactgcagatggaaaacctccagtacagaagaaagacacagagatttcccatgcctctcaggcatattttgaatcaatgttccttggccatattcctgcaaatgttcaaattcataagaaagcaggtcctgtttatgggttcaggggctgcattctagaccttcaagtaaacaacaaagaattcttcatcatcgatgaagcacgacatggaaagaatattgagaactgccacgtcccttggtgtgctcatcatctgtgccgcaacaatggcacctgcatcagtgataatgaaaatctgttttgtgagtgtccaaggctgtattcaggcaagctgtgccagtttgcaagttgtgaaaacaacccatgtggaaatggtgccacctgtgttccaaaatccggaacagatattgtctgcctctgcccatatgggaggtctggacccctctgcactgatgctattaatattactcagccaaggttcagtggcacagatgcctttggatacacctcattcctggcttattcacggatctcagacatcagcttccattatgaattccacctgaagtttcagctggcaaacaaccactcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaaggctgtattttcactcttcaagttcgcactgagaaggatggccatttcagaggactgggaaatcctgagggccacccaaatgctggacgcagtgttggccagtgtcatgcttctccctgcagtttaatgaaatgtggcaatggtgggacatgcatagagagtggaactagtgtttactgcaattgtaccactgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaaggtcatcaatttattggaaaagatgttttcaaataatttatccaacatttttggtggttttcatgatggagatgaggtaaatcatgttatctaatctactatactgctggaaacaaaagtcaactattggatttattttaaaagaagcccatctggccgggcgcagtggctcatgcctgtaatctcagcactttgggaggccaaggcgggcaaatcacctgaggtcaggagttcgagaccagcttggccaacatggggaaaccccgtctctactaaaaacacaaaaattagccgggtgtagtggtgggcgcccgtaatcccagctactcgggaggctgaggcaggagaatcgcttgaacccaggaggcagaggttgcagtgagccaagattgcgccactgcactccaacatgggtgacagagcagaactctgtctcagaaaaaaaaaaaaaagaaagaaagaagcccttctgaccagtattgcataaagcattaaaaactatagaagaaagttaaaagtgctatgagaggacattgcaagtgggaacaccatcacttggtcccaagttttgaggagcagatactgctagaccctgatcagtgattttaagggtagggaagggacactgataaagaaaaaggtccttccatagtagtacatttaatgtgccagcctgtaacttatccctccatcctcattaaagcagcaagaaagaagataaaacagtgtcctttttcctttttaaaatgcatttggtgtaaaaaataatgaggtatgcccaatatcatggtaactcaaagacagcttaactgatgaattaaaaattaaagtatgcttgaacacaagcaagatatggagtatgcatgagaaaaaaatacattataataaaaagaaaagagaagccactaaaa

SEQ ID NO: 6933 - DNA, 718 bp, Homo sapiens
  ENST00000486069
actcagcactgcaaaataacttgatattttttactggacagaaaggccatgggttgaatggcgatgacttcctggctgtgggcctgctcaatggcagtgtggtttatagttataacctggggtctggcatagcaagcatcaggagcgagcccctcaatctgagccttggagtccacactgttcatctgggcaagttcttccaagagggctggctgaaggtagatgatcataaaaataaatccattatcgccccaggaagactggttggtctcaatgtcttcagtcagttttatgtaggtggctacagtgaatacactccagatctcttaccaaatggagcagattttaaaaatggttttcaagttcaaaaggcaagagacagactgcagtcaacccatccataccaccaaggggtagcccacagaggccagagcaagccaagaggattaaggacaacattgtgcttggaaacattaagattgcacactcctggaagtatgtcaactgccacagtctttatctcgctgtgtcatcaaggctggagtacagtggtgccatctcagctcactgcaaccttcatctccagggctcaatcaatcctcccaccttagcctctcatgtagctgagccactaaacccagctaacatatccttacaaagctgatttatattgtagtagagttataaaataaagacatgctttaaattgtaataacaa

SEQ ID NO: 6934 - DNA, 484 bp, Homo sapiens
  ENST00000330816
ataggtgacaattgttccaatccagaccagcttatgttggatttggagaggcaggaggttcaaaatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacactta

SEQ ID NO: 6935 - DNA, 567 bp, Homo sapiens
  ENST00000370615
catcatcatctgcagcattaattacaactggtggatgcttggggctaggaacattttcggaactttctactttcataacgctccgcagctgaggggaaggattggactggacagacaatttgttctgctgaactgaaagttggctagccttcacttcctcttctggtgactcaggcacagtgggcaacacacttttgctcggagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggcaagttttttttttcctgataaattaaattttctagtaaataatgttgttaatatatttatttgatatatctcaaatatatctcaaatgtgtctattgattggta

SEQ ID NO: 6936 - DNA, 517 bp, Homo sapiens
  ENST00000447127
ataacgctccgcagctgaggggaaggattggactggacagacaatttgttctgctgaactgaaagttggctagccttcacttcctcttctggtgactcaggcacagtgggcaacacacttttgctcggagcctgttccattcttgagcaatacacagagcccagggatgtggtgcaatactacagaggagaaattaagtaaaaatctactcccaaaacaaagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggcaagttttttttttcctgataaattaaattttctagt

SEQ ID NO: 6937 - DNA, 5450 bp, Homo sapiens
  ENST00000393380
agaaacaaagtgatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagaagaatcctcaacacggtgataccacaccaaattcagcaacatatagaaaggtttatacagcatgaccaggtgggatttatcgtaagaatataagtttgatttagtggcttaaaatcaattaatgtaatttaatgtatcaatagaataaataaagaagaaaatgcatgataatgtagatggagaaaaaaattgtattacagaatctcacaacactttatgaaacaaacactcaacaaataaagaataaaagggaacttccacaatctgataagagaagttaaaaaaaaataagaagaatgaagaaacataactaacattatactttacggtgaaaggctgaaagactggaattttaaatcaaaacaatgagataacactttacacccagcaattctacttctagtatatactcaaaaaattgaaaatatatgttctttacaaaaatttatatgtgaatgtttacagttttgttcgaaagagtcaaaaagttgaaacaacccaaatgaccatcaactgatgaatggatatataaaatttgttatatccatacaatgaaatgttattcagcaatagacaaagatgaattactgatatgtgcttcaatacgaataaacattgaaaacattttgataaggaaaagtagtaagccacaaaagacacatagaatagtgctcaacaaatacttgtttaatgaaacaatgattttcagaagcttttttatttactaagaaaattatccttcgttttgtgatgttatttccttttttctgattttgtgattctcttttgtttgccattattttttgatatccagagaatcttggataaattacaaaatttttgtaatttatcaacactttaatgagttcttgatattgtctcataattaatactaacaatggagcccaacaaatgttgcagatacaagtattttatataaaattaagtttctctatatcagttgcaatatctagaaattatatgtgtgataccacctgttataatgtcaaaagatatgcaaaatgtttagaattaaaaaaaagatgctctaattctccattaaaaagaccctctatataccactaagctcaatgaaaaagagaaaattatatatacactgaataaatggaaatataatgcatggagttaaatattaggccttaaattagctaaaatattaattcttcccaaattaattcacacatttaatgcaatagtaaaaatattgcaagttattttagaaactaattatcatgttatatatatttatgaataatattttctaaattatgaagtcatctttgaaaaggaagactaatggggtgggatctgatgaaccatatgacatgacagactacataacacatatgggtgcctttaaaggaaaaaaaataataatgggtcaacagagagctctgacaacaacccgagtatatacgggaactcaatatatgagaaatttggctataatctcatttgaacatacagggttctttagtaaatggtattgaggaaatggctcataataagaccttaaatgaaactggattacaaccttataccttatatagaagtagactctaaatgtgtatagggatctaaaagtttaaggtaaaatgacgatataaatgaaagaaatgtagaaaaatatctttgtgatttcgggatggagaaatttttcaattaaactcaatttataaggcaaaataatgatagtattataatgatagacactaataatgttgatgatgttaacggacacaaagttaatgaatagcgtataaacattttcttttaaagtgtattttaaatgggtgcagattaaaattcattatataaatgatgtattgcaaacaggtctgcatattaccacatttttttgccctgaaatcttcaaaaaatttttctgggggtttataaaatgtttaatgagccaaagactaaatcataccagccatattgttacttaagaccaggaaagatttgctaagtctgggatgttaatttcttaataccatgcccagactgtgaagtgttcatgactcccacctgtttttgaagcctcaaatttatgtctaagtcaccaatccctacttgctaccagaaatatcataacagaatgaaatatattcattcatacatttattatttattgaatctcctctaactggaagatatttttcaaaatgttatgacaatgagacatgatacctgtccccaggtaatgtactatacataggtaagattatacactcttcagaacacatctcatggttcttctgtttcatttagaaagtgaacacatttttaaagtactaaagtaattatttttttcactttctgaacatacaagttgcttgattatagcagtgtgtcttctggctttctttctggaagttttaaatttaacctgtttcctttacaggctattttaggagattcacattttctgtgtaatgttaaatatatccaaaacataattttcagttataagtaagagttctgtttcaaagtgtagaatctaaaagtccataagaaaatcaggtgaagtttcaaaaactatttctgtagagtcaggaggcttgtaaaaatagagctttatgtgaatatggcacaaaagtatagtataatttgaccaggattttcttaaattatttctgatcccaaaagtctaataattatttattctaagactattgtaatttctgccgtgatgtccgtgattttattaacaagttgaatagttggttttaggtttatttatttattttggctatactatgcaaacttttctgccttcaagtaaaagttttatgtgggtatatttttacctttaaagcaaaaaagatatcgaactgcatatgaaagtgtcatattgaatgtatttttgggttggggccagtcttgaaaccactagatcaagtgtctaaatctttttgtctaaggcacttacatacactgatatattttctctctttattatgctctagaaaaccaaataatcttggttcttaaatccttatagtaaaatgatatagaaatcattcatttaagcaattctagagtacatatcattgtattacccatacacataccaaaattattataacaaacttcattaaatgaagcatttttgaataataaa

SEQ ID NO: 6938 - DNA, 2168 bp, Homo sapiens
  ENST00000342421
gtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccaggtatttatgtatcatttgagcagataatatcacatatcaaaaagttataattaaattgatagtcatcgaa

SEQ ID NO: 6939 - DNA, 2622 bp, Homo sapiens
  ENST00000489873
gatacacgctaggcatgtccagacattaaccgtaatcagaagcctcctagggttgcaagcctccttggctaatggttgggctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtaaaaaatgcatatgtatacaaccatatacacaagtaactttaattttatctatgtatttcaaattaaatgtgaaatatttcctttattattgaaaaatacaatttcagaaggtatatatactgaactcttttatggtaaagtttaataaatcaatttggttaatacaattaaatcatattactgctaaatgttttatagcataagaagagtctgaacaacagttcacatgcttttcaccataaaattacttacatctttcttcagacttgcatttatgaccaatgaatttgaaattgttcatgtgtttatttgacacttcttaaccattacattttaaattatggacattttcactgaacacatgttgaggtttctgttaatttctttaaaaaaagtctgctaaaggaagatattattacatctttttttgatataaaatatgcagatgaaatatatatttttaaattacactttaagttctgggttacatgtgaaggatgggcaattttgttacataggtatgccatgtgccatggtggtttgctcacccatcaacccgtcacctatattaggtatttctcctaatgctatgcctcctctagccgccaacccccaacaggccccaatgtgtaatgttccccttcctgtgtccatgtgttctcattgttgaacccccatttatgactgagaacttccagcgtttggtttactgatcttgcgatagtttgctgagaatgatggtttccagcttcatccatgtccctacaaaggacatgaaatcatcctttttttttatggctgcatagcattccatggtgtatatgtgccacattttctttatccagtctatcattgatggacatttgggttagttccaagtctttgctattgtgaattgtgctgcagtaaacatatgtgtgcatgtgtctttatcgtagaatgattataatcctttgggtatatgcccagcaatgggattgctgggtcaaatggtatttctagttctagatccttgaggaatcaccatactgtcttccacaatggttggactaatttacactcccaccaacagtgtaaaagcattcctatttttccacaacctctctagcatctgttgtttcctgactttttaatgatcaccattctaaatggcataagatggtatctcattgtggctttgatttgcatttctctaatgaccagtgatgatgagcattttttcacatatct

SEQ ID NO: 6940 - DNA, 1253 bp, Homo sapiens
  ENST00000471279
taaaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccgctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacagggttgcttggaggcaaatgaagaaaaaagttctgcattagtgaggcagggatgtcagtatataaggaatttgaaagacatcaatgataatggcaaaaactgctcataaattaaattaagagcttaattaaactggggaaaaaaacatattgccaaattacatgcagttggtttgtaacagcatttgtccacttgctatgccctgggattttcaaggcacattcctctactaaggaaagaattgctcagaaataattggccagtgtcaaccacatgtctgtt

SEQ ID NO: 6941 - DNA, 2287 bp, Homo sapiens
  ENST00000334047
gcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactacagtaaatgactgtaaaattgtca

SEQ ID NO: 6942 - DNA, 1879 bp, Homo sapiens
  ENST00000370207
catggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttg

SEQ ID NO: 6943 - DNA, 472 bp, Homo sapiens
  ENST00000478217
cactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaaggtgagcattttttaatttgtttttatgacctgttttaaattgtgaatacttgggttttacaacccatttcttccccaattcaaaaatagcaga

SEQ ID NO: 6944 - DNA, 1193 bp, Homo sapiens
  ENST00000480356
aagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatc

SEQ ID NO: 6945 - DNA, 2075 bp, Homo sapiens
  ENST00000562145
ggacacctctagtgacacttccgggtcatcccgccacagaggctgcattaacctcagttgccctcagtgccttgctctcccagacaacatcaggcctcagtctaggtgccctgtctccagaatgcccctctagccaggggcacggcatttagggatgggatacctgtctagcacctgacaaattccagagtcacagtggcctctataagatgggctctgagccgccagcacaccccacccatcctgcccatcctgcccatcccgcccatcccatgttcctttgcaatctgccaggtcccttcctggctcacaaatgggaagtaagacagtctctccagatcttccagacgtggtggcccgccctccccaaagccaccaaaggtgccaagcctacgcagtggaatgtctgggccgctgtgcccctgtcctctgcagggagtggccagggtttggccagctgccggggcccctggctgcctcctgatgcccaagcctctccatctgcaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaa

SEQ ID NO: 6946 - DNA, 2424 bp, Homo sapiens
  ENST00000219368
atgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaa

SEQ ID NO: 6947 - DNA, 1537 bp, Homo sapiens
  ENST00000567683
cccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttggg

SEQ ID NO: 6948 - DNA, 578 bp, Homo sapiens
  ENST00000569949
aatgcccagcttccagctccctgccatggccaccagcaccatggcttccttcagtcacaaggacacagagaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 6949 - DNA, 292 bp, Homo sapiens
  ENST00000618933
actcttcacgtcatttacaacaggtaatgccagtttctttcctgacttgccctgaggatcctagagggaggagacctcagtgctttccctggcccagagtttctgagagcacagaaccccaaactacatcacagacatttttggtgaagcctctctgtagaaatagtcttccaaagaagaattttgtctgactcccatctaccccccaaatggatacaaaacccaacaacacatcagcagaaactaaatggaatcatcgggtggcatagcaataaaaaaagagagagagaga

SEQ ID NO: 6950 - DNA, 4144 bp, Homo sapiens
  ENST00000373095
ccgcgcggcgtgagctccccggacatcgcgtctcgggatgctgcaagccagcgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttcttt

SEQ ID NO: 6951 - DNA, 4316 bp, Homo sapiens
  ENST00000465821
gggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccaggtagggcaggcttagggaggggtcgtcggggcggctggggcttgggggtgagagcagagtccccacagtccactcacctggccttgaacgccaaatcttgtcgccacagtgtgaccctgggcctgtcatgtctctgaacctccctttccccatctgtcaggctgtgtggacaccaccacctcacctgggagcctggggcagtgagggcacggacaggttcggtggtttcccacagttcacaaggtcacctccagcaatgcctggtgcagggctcagcacatggcaggggcctcacacgcatttatttagaaccctcccttctacttcctcccagctccagggactcgggaagaatggtggtggtgatgcctcatgggtttactgaacaaatctttccctagcaccagctaggcactaggccctaagtgaaggcctggttcaatgcaggctgctgcctacacagcatccacagatggcaggggtagatgggaccaaagttgcgggaacgacagtttatagagtgctgcgtcacagacattcatttggagcatgttgactatgtgcctggctctccatgtgctttggctaaccaaatgaatgagcgagtgagcgaatgagcttcccacaggcgggctgctgagggcaggtggggagcccgcctaacatccacatccccagggaagaggcgtggccaggccgctgcgcagaggctaccctctcaagctgctctgctgactcctgctggccacggcctggaatggcagctatcacctcccagtagcctcctgggctgctctcgggtgggggtgagggggcggtgagcaagaaggaaactgaggggctggcttccttatgggtttgtaaacacacccctccctggccccctctgaaaatgaggaagcatcttggggaaagaaaccaatctggttgggagcgagatcacagcagagctacatgctgagccccgagagtccccgactccagggctgggcctgggctcggcagggaaaggagctgaccaggtttcctgacttcccactgccctcttggtcaccctcacatccctctgagcctcagtttcttcacctgtcaagtggggcaggatgcagtgactccctgccgaggtgaccgtgaggatggggtggcacagccagatgtgcccggaagggctctgcaggccccacagactctgatgcttactatctgtgtcactgtgggcaagggacttaccatcgctggggcacggttttagcccctttgcaacacagggctggttaacagtacctgcttgtgaaacacctccagaggcctggtccagtggagcgctcaggaaatggggtatcgagggggacatgctgacctgtctctcacctgcagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatc

SEQ ID NO: 6952 - DNA, 3352 bp, Homo sapiens
  ENST00000373084
gctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatc

SEQ ID NO: 6953 - DNA, 3148 bp, Homo sapiens
  ENST00000300434
gctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaata

SEQ ID NO: 6954 - DNA, 366 bp, Homo sapiens
  ENST00000479828
gtcccggtccgatttgggatacagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctc

SEQ ID NO: 6955 - DNA, 423 bp, Homo sapiens
  ENST00000493175
gctgactgcggttcccttcgtgaacggggtcctcttctgcaaggtccggctgctggatggaggggattttgtcagcttgtcgtcaaggagctgaaaggcgggaaggcttattccaaggtaagaggggctgtgtgaaggggcagtgggatggaatggggggtggcatgggacaggcacaagggaagcctccagccccttttctgccacaagcaagaggcactcagccctacctgagatgtgttattttttagaaatatctttattgatggtctttgcactcaatataaaggcagcatatggttgttgcaatataaatggtacagaagtccacagagcaaaagggccagtttctgtcccctttcctctctccaggcctctttctgggaccccattattggatagattaagacctttccagacctt

SEQ ID NO: 6956 - DNA, 536 bp, Homo sapiens
  ENST00000494606
gcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccggactccgatctccgccgtctccgccaccatcagggcgggatccggctctggtgttttgaggagggggtgtggtgtagggaaaggaatcccgtccctctccaccttttttcgccttcggggcttcagactcagggaactcgctcatggctttcttgatgaagaagaagaaattcaaattccaaactactttcaccctggaggagctgactgcggttcccttcgtgaacggggtcctcttctgcaaggtccggctgctggatggaggggattttgtcagcttgtcgtcaaggcctgcaggagacatttccatcctgcttctgctacttgctgcctgtgtgaccttgggcaagggact

SEQ ID NO: 6957 - DNA, 5600 bp, Homo sapiens
  ENST00000370035
tcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaagcctgctttttctttcagaacaccccagcggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagttta

SEQ ID NO: 6958 - DNA, 1585 bp, Homo sapiens
  ENST00000405454
tcccgactcccagacgggcggcagcggcggcggaggcggcggcggcggcggcggcgagctgagcaccaaaagggcgctcacctccccgggcgagctgcagcacgaccgctccccgcgggcggtcggggtccgcgccgcagctgccgccgcgttccggcccaggctgccgcgagaggcggcggcagcggccccggccgcggccggcctgcggcgccccccggccgcgcccccgcgcacagctcgcggccccggccatggggctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagatgcggctgctggacggcggcagcttcaccgccgagtcctccagggaggtggtacaagcaaactgtgttcgctggagaaagaagttctcatttatgtgcaaaatgagtgcaagtgctgccacaggcatcctagatccttgtatctacagagtatccgtgaggaaggaattaaaaggtggaaaagcttatgcaaagctgggctttgcagatctaaacctggcagagtttgctggatcaggaaataccactcgccgctgtttactggaaggctatgataccaaaaatacaagacaggataattccattcttaaagttttgatcagtatgcaactgatgtctggtgacccatgttttaaaacgcctccctccacttcaatgtctataccaattgctggtgaatctgaatctttgcaagaagatagaaaaggtggagagactctcaaagtgcatcttggaatagcagatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagtgccctggaagctccctccttgctttgagttgtccccgcctttctggatggaaccaatgtacttcttacatatattgattaatgtctcatgtctccctaaaatgtataaaaccaagatgtgccccgaccaccctgagtacatgttgtcaggacctcctgagactgtgtcatgggagcgtgtcctcaaccttggcaaaataaactt

SEQ ID NO: 6959 - DNA, 8333 bp, Homo sapiens
  ENST00000483371
ctataccaattgctggtgaatctgaatctttgcaagaagatagaaaaggtggagagactctcaaagtgcatcttggaatagcaggtatggatgtgtggcttactggttttttaatttgtgagagacgacttgatgccctaaaaattctttgggaattgtgtgggtatttgacttgaaacaggccaataagaatcaacagttttaattatgtaattcttggttgatccagtgctttattttgtctaaagtattgtgctctgacagattaaaaactagatgttacaatgacactctcctcactgtatgcatctactccccacaggtacaagagaatactacaggattttttccatttttcccgttccattaccctgcaacttctgcaaagcagcttctgcctctcgggtgtcgctcctcttccatgaatcgctttccctctgtcagtggttctcaagccctagtgtgcatcagagtctcctggagggcttgtgaaaacacaggttgctggcggcagcagccagagtgttcgattcagtagatctgggttagagcctgaagttttgtatcactaaggcattcccacaagacgctgatgctgctagtccctgaccacaccttgagatccacatttccagacacacttctggcagcagtcagaatctgctccagaagtaaaagcatggtggggataatgtcaaggttgcaggaggaaaaggacttaggagcttccttctttcttcagtattatgtgaacaggatgtattgtttgaaagaagggaaaggtgaagttatataattaaccctttcactgccttttaaaatatgcaaatatttggtttcttataaataatggtgactctgaaatttcctgttttgggatcagtggatcttttgggaacttgtaaccattccattagctccttctcttcagcatgtaaatatgctgatttctttctcctactgaaaaaatgaaaacaaaaactccttagccctacatccttctctatctactgcactcccttagactccagcaggctggcgcatgtgctcacatgctctctctcttcccccactctgccccaaatatagatacatctctctctctctctctgtgtgtgtgtgtgtgtgtgtgtgtgtgtgtgtgtgtgtgtgtgtgtgtgtgtggagagagagagagaaagatcagcaagagatgatatatgtaccacacacttcttatagccaaacttctagaaagaatatactgtccatttattcctaaacacattagcagtctggcttccatcatctgccctctcttgctgctatcccctgatacatgattgtcaagtcctgtggacatttgttctggtcttatctgatggccagttattcattcttgatgctttctcttcccttggctcctacctctctgatctttccttttctagcttcttagaggcttcttcatcttcctccaacttccctttacatattgatgttccaaagggtttggtcccctcacttccttgagcaataccatctatacccttggctttatctatcacataaatgtaaatgtgattctgtgatgtacatgtgatcaaatgctttggggaaaggtccacttcataccaaatgtaacactgaaatccatctgtttctctttctacccagccagagtctaactaagttcttcatgatcaggtcttatttatttctgtatccccagcagaaggcccgggacacagtagatgagtgactgttgaataggcatcctcaggtgtctctaattccgcatatctagcacaagtcttcctaccttttcctcctgtcttttctacttcagttttcctgacacaaacttctcctttcttattgagtcctgctatttgtgcctatgaaacatctctccctctcagctggattattatgaaaacctacactcttatgccccctgtttatcctgttgccagagtgttcttcccaaaatgtagatttgatcatgtcacaccctttcttaaagccactgaactgttttcttctttaaactcatagaaggttcttcatcaacaggcatctactcatctttctagccccttttccctcggttattatactccactaccctatatgccaactttaccaaacgatctgcttccctacaaagaaggcatgctcttcccggtgcctttccttgctcatctagctcaggagttcctatacgtcgctcaagtcctggggttaacctcctctgttaccaggttgtgtcagatgcactgtcctttggagctcttaatagctgcttttttgtgcttgtatttttgtacttaccacattgtataagttttgcttctacctctaaactctaagcatgtattttgtcttattttgtacttcctataccttgtacagtattaggcacctgactgggtaaaatattaataaatattgattgaatgaataaattttgaaaaccagaagatatgtggatgacttaagatctgggccaaacccagaagtaaagagcgctgcataactcgatatgaaccaactttttgagttcagattttgctgaatgtttgcttttggaccacttatactctgtccagaaatgagaaacctttgcagaaggaccaggttactccagtattttccttgttttgcagcatttgttggtccaactgcatgcagtatcatttatagaatagctgctataatagctatgttactcaattgctttccttctgcttctaagttaaaaacagttcttgtttccaaatatgattgtgccctagggaaaatggtcacagttctgcattctctggaagaagcctggttctgaaaatatgtaattggcacctggaacatacacatgatcagaaactattagaaatggctttgacactgccttttgtacatttactttgaatatgaatactataatcactttcttaagaacttttactctcagtgctacgtcccatgctgtgttgatttaagccacagacattgcccaaattatagcctagcactaacaacactaacattaaagtaatagagtactctttagcttgctgttgtgatggatttttaaggaagcagtatttccttagaaaccacattaaaacctaccaattttgtgaacatttataagaatacatctgagtcatttttgttagagaaatactgaacactaaaactgtagcagttttaagatagagtgctgttaaatgttttgaacaacaggagtttattgcatagactgaactaataaaggactgaaataattttttaatgttatgaaaaatataattcttcagcgaactaaggtatttaaatactttgtatatcttgcaatacagttacttccattgcactgacttaaaaggatgtccctcattttgtaacttattgttttgataatgaacttggcagagtttataaagtctgcagagtagaatacaaattgaccattaactttttggcaataagaatgacatcatgttatgacatattacagatctttcagcaaagagtgcctctgttccagacgaacttggtgcctgtggacattctagaacatcaagctatgcaagtcagcagtcaaaagtatcaggtagaggctaacagtgaagttgaattccttattgttccaaagggacttgaaactgctgtggtgtgggggaacgatgtcagattgcagagtgtttgatatgagtattatatccaaggtgattttctctgacagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagcgagttgatgacaccagggtggatgcagatgacattgtagagaaaatattacaaagtcaagacttcagcctagattccagtgcggaagaagaaggactaaggctatttgtgggtcctgggggaagtacaacctttggcagtcatcatcttccaaatagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaagcctgctttttctttcagaacaccccagcggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaa

SEQ ID NO: 6960 - DNA, 3367 bp, Homo sapiens
  ENST00000360997
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 6961 - DNA, 3465 bp, Homo sapiens
  ENST00000394481
ctgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaa

SEQ ID NO: 6962 - DNA, 2159 bp, Homo sapiens
  ENST00000464064
gctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccaggtgggtgatgggcacccagcagggaccacgcatcctccagggctgtcctccagggaggagctctgctgtggccacagctagtaagagggaagaggatcagcagacagagcactggactaagagtccactcctggcctgagtcctccctctgccattcactttgctaggtccttagggcgagtggcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttctgtttccccactgagtgggcccttggtccaaactccacaggttttcagagtaggaatccccctagctccacccacttcactctctgcttctccctccttcagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 6963 - DNA, 2271 bp, Homo sapiens
  ENST00000474531
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 6964 - DNA, 1432 bp, Homo sapiens
  ENST00000447756
ttcccccggcggcgtctcctcgcccgcccctccggccgccgccgtaacttgaccctcagcggggtttgggacttggggccgcgtcaccgtcgcggaggcgcttcggctccggactacgctcctgctgtgcgctcgcggggccagcagtgctggctctgcagtaggaggcgcgggggcatggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgtt

SEQ ID NO: 6965 - DNA, 580 bp, Homo sapiens
  ENST00000465970
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcaga

SEQ ID NO: 6966 - DNA, 834 bp, Homo sapiens
  ENST00000497310
gcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaagaaaaagaaatgaaggcccagacacgttacgccatttgcccaagaccacacagccagaagagagtggctgggatggacctatacctgccatctcttcacctgcatctgctgggaaccccatccctcagcactggggccatttccagctcctgcatcatggggcctccttgtcccctttcccatgaccaggccctgaaaatgctcccaccccaatcctgccagctcccccaactcctgagaaagtcccctctgagagccaagagtccctgcagatctcaggaaggtgtccaggggaaagagatgcatgcaaagccccattccagctctgccaactcactgcttattcattaataaaagaatgcccaggctattttgggcacctgta

SEQ ID NO: 6967 - DNA, 3316 bp, Homo sapiens
  ENST00000378470
ggcccccgggggcttctgggagtgcctgccttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgcaa

SEQ ID NO: 6968 - DNA, 3785 bp, Homo sapiens
  ENST00000181796
acagaaggaagagcgcgaaattgcccaggatggacactttcaaaggggccccagcggctaagtgactctcagggaaggtggccttgccatcccaacttctatttaggggcaaccactagcaagttcttctcttcgggcaattggaaagagttcctataagcaaagtggaggtgatgtggacccctggaaaatttccttgccccgtttgaactttgcaatgattcactgcaagtcatgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatg

SEQ ID NO: 6969 - DNA, 2633 bp, Homo sapiens
  ENST00000468747
gcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaa

SEQ ID NO: 6970 - DNA, 2374 bp, Homo sapiens
  ENST00000378467
gcggggccgcggggagcgagagccgccctgcgccggactggcttgcgggccgggccgccgcccccggagccgccctcgcgccgcctcgggccgccgccgagcagtcgggccgctgggcgccgccgcgggcgccgggagcgagctgggagggagccgcgcgcctttgtgcgcgcgccgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaa

SEQ ID NO: 6971 - DNA, 2317 bp, Homo sapiens
  ENST00000487335
ttccttgccccgtttgaactttgcaatgattcactgcaagtcatgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaa

SEQ ID NO: 6972 - DNA, 1052 bp, Homo sapiens
  ENST00000378465
agaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaa

SEQ ID NO: 6973 - DNA, 1284 bp, Homo sapiens
  ENST00000378458
attgtttgctctggcttctgtgccggatgaggtcattcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttctt

SEQ ID NO: 6974 - DNA, 790 bp, Homo sapiens
  ENST00000478076
atatcgagtattgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagt

SEQ ID NO: 6975 - DNA, 692 bp, Homo sapiens
  ENST00000378462
gtttctctttgaacttgaactgtggctcttttgatatccagaaagagagttctttgtggggatggttaattcttgttttgggtgcttttcttcaccgctctaaggaactaccacagtcagaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgc

SEQ ID NO: 6976 - DNA, 857 bp, Homo sapiens
  ENST00000481209
ttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgcttccagctacttgcagccagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggattttggtctggttggaaatacattaaaaaaaaaaaaaagaaaaggcagatttcaaaatgaaatgaaaatatatctcatcttatctcttaagagttttcaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagca

SEQ ID NO: 6977 - DNA, 568 bp, Homo sapiens
  ENST00000475858
ttatgtactctttggagatctcctcttgcctttctttcgtgctggtgaatttcttagatcaccatgttgcctgctgtagcctagtaggtatcatactaattttgtagaccacttttccgtggttgatattgtaagttaaatttctgttcataaaaaatgtagccattagattaacgttttctatttttgttaatgctctttcgcaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttca

SEQ ID NO: 6978 - DNA, 697 bp, Homo sapiens
  ENST00000496330
attcgtgggggaggtgtgtttgtggagtaaggcagtgggagggtagaggaaaaggagataaagaaaaagcccatttctaactctctgaacaggcgaggccagcttatctgagatgcctgtgatcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtg

SEQ ID NO: 6979 - DNA, 558 bp, Homo sapiens
  ENST00000492700
ctttttcagccagagaatcctggtcaagccctgaacagtccagaaactctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtg

SEQ ID NO: 6980 - DNA, 570 bp, Homo sapiens
  ENST00000479731
atatttgcttacaagtagaggagctgatttttgtacagacaagtacatttcaccagtgctgccagcacgttctcttggtctggaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcacc

SEQ ID NO: 6981 - DNA, 625 bp, Homo sapiens
  ENST00000468492
acccagggctggagagtctgcgtgcatatttgcttacaagtagaggagctgatttttgtacagacaagtacatttcaccagtgctgccagcacgttctcttggtctggaaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtc

SEQ ID NO: 6982 - DNA, 834 bp, Homo sapiens
  ENST00000452706
attcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagccc

SEQ ID NO: 6983 - DNA, 559 bp, Homo sapiens
  ENST00000489100
acttgtggctgagcagaggtgtatgtagtgcatttaggattttgccgaggagcacgtttttccatgggacagtgtgttgatatcaggctggctgtgatgggttccctgagtcaccctctgcgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgccc

SEQ ID NO: 6984 - DNA, 561 bp, Homo sapiens
  ENST00000494865
ctgcaagtttagcactggcctgtcctgattagtgaggacctctgattgcctaggccagggctcaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagt

SEQ ID NO: 6985 - DNA, 583 bp, Homo sapiens
  ENST00000475786
attgagaagggaatgtgcttggtctgtcttctctctctgcttcgtcacctgccagtcctgagggccccaggcagcagtgcagctttaatgtggattcctatggatcagaggtgtcctagggctcacgttgttattctgcattgcacttgcagccaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgca

SEQ ID NO: 6986 - DNA, 552 bp, Homo sapiens
  ENST00000488576
gcttttcttcaccgctctaaggaactaccacagtcagaaggtgcattcttactgcgatctttttatttgctaccttgggcttaaggagcctgcctatatctactgagccagagaatcctggtcaagccctgaacagtccagaaactctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcag

SEQ ID NO: 6987 - DNA, 467 bp, Homo sapiens
  ENST00000474143
agatagaatgattgctttggcattaagaaacttgttaactgactttcactatgttttttttttaaaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagca

SEQ ID NO: 6988 - DNA, 458 bp, Homo sapiens
  ENST00000442012
aatgtgtgttagctgtggacttagaaaaaggaggccaccagaacaagctggaatcttggacagggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagtt

SEQ ID NO: 6989 - DNA, 549 bp, Homo sapiens
  ENST00000482277
aactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctatt

SEQ ID NO: 6990 - DNA, 475 bp, Homo sapiens
  ENST00000472095
gtgcttttcttcaccgctctaaggaactaccacagtcagaaggagaatgcagttgaaactaattttgtggatagagaaactgttggaactgctttacaaagtattttactctttcaagatcaaatgaagacagaattgttcaaagcgtgggttgacctcccctactcagtttttggctccttttggaaatctgatgtctgcccttctaagcgtaagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagca

SEQ ID NO: 6991 - DNA, 899 bp, Homo sapiens
  ENST00000471815
cgcgggcgccgggagcgagctgggagggagccgcgcgcctttgtgcgcgcgccgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaagaaccgggttacccctccgtgaggcagatcccctgcaggtggccatcactgtggtggccagcagtgcttccagactcctgcagtcacgggttcccttctgaaatggatgtgtatttccaaattcggatggaagaggctggattaaagatagaagagaatgtcctaagtagaagagaaatatgttcttaaatttaaaatctctgaattttctccttacactggggaaggtgtaggaatcatgtaattgccgcctactccggcatttgtcagtagtggggagaagtctctagaaccatattagacttaatagataggacactcatgtttttgtttgtttgggggtagcattttaaaagattattatcatagtctttattattaattattttggaggacaggaaagcatttaccttctatctactttgcaaactccatctgtgccataaatcattatggatgttgggttgctatactctgctttttaaataatttgggcaggacaggagactaggagaactgaggatgaaaggctatttttttcaatttaagaactaggaagcttcatttaggattattttcagatctcgtaggactatagatgactcatttgcccactctttgctaagccctggtgaaaggtctcccactgaactgaaagat

SEQ ID NO: 6992 - DNA, 558 bp, Homo sapiens
  ENST00000464952
agtcagaaggtgcattcttactgcgatctttttatttgctaccttgggcttaaggagcctgcctatatctactgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaagaaccgggttacccctccgtgaggcagatcccctgcaggtggccatcactgtggtggccagcagtgcttccagactcctgcagtcacgggttcccttctgaaatggatgtgtatttccaaattcggatggaagaggctggattaaagatagaagagaatgtcctaagtagaagagaaatatgttcttaaatttaaaatctctgaattttctccttacactggggaaggtgtag

SEQ ID NO: 6993 - DNA, 542 bp, Homo sapiens
  ENST00000495292
attcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttagtccaaggggtcaaaagaataggaacataaaccagacatgttctttgcagtgaagagaggataagatttatatccacattgct

SEQ ID NO: 6994 - DNA, 425 bp, Homo sapiens
  ENST00000491458
gggagccgcgcgcctttgtgcgcgcgccgaggtttgcatataaccacctgtacagaagggagaagaaagaaacaggaaaaacaatgtaaatttccactttatttggaagaatgggctgacaaaaaagtttcatggactatatttttgaattcaggagtcatttgggattgacttttgtctttaaatgaaatctttaagctttaaaaatattttaaaggtaacattgtgttctgagattcataagaaatatgtgatggaaaggaattcttgtttgtggaacaaggaatagcagtgattgtacaaccgggtgcatgctggcttcttaaagaccttgcactgagaaagtaaaataagggttttcctgagaatcgtgagttgtgttgagtgtgtatgttcttttaaaataaaatcgttctttagccaca

SEQ ID NO: 6995 - DNA, 3510 bp, Homo sapiens
  ENST00000622567
attgtttgctctggcttctgtgccggatgaggtcattcagttgcatacagttcctgctttcagaagttgctagagtgtttctctttgaacttgaactgtggctcttttgatatccagaaagagagttctttgtggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctacagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgtcggtctcctctcaccccttaatactgtgcagcccaaactcctaggactcttgaacatctgagcagttttgtgctttgagccactttttgacaaaaatggctccatttttccacagcgtggttttcttaaaatagtttaatgttttatagtctcatagtagtagtgttgctttctaagctataacagtcgactttattcttctactctgaaaaatcttgacttgtttgagtgtatataatatatataaagggagccttaatggattggttttcataatttaatattttttgtatttgctcttgtataattgtttttaacggaaagtattaaagaattgagggtggaattcttagaaccaaagttattcttaataaaaatcaccacatgcttggaccatgc

SEQ ID NO: 6996 - DNA, 567 bp, Homo sapiens
  ENST00000510213
ggccgggcgtccccgcggcgctcctcgtggggcggggcgcaggcggggcggggccccctctccagccgcccgccctccggccgcgtccccgccggccctgcagacgtggcggggcgggacccgctgggcactcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctgggg

SEQ ID NO: 6997 - DNA, 1431 bp, Homo sapiens
  ENST00000515037
ctccggccgcgtccccgccggccctgcagacgtggcggggcgggacccgctgggcactcccgcgcgtactcggccgcctgagcggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacct

SEQ ID NO: 6998 - DNA, 4050 bp, Homo sapiens
  ENST00000358869
gtactcggccgcctgagcgccgacccacgccctgcctgctcttccagtccagccaacactctaagcaggcaccgcctccactcgcagcccccgggatgggtcccactccctaccgcagatccccaggccccctccacccagtcggctagccctcgcctctgccatccgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttt

SEQ ID NO: 6999 - DNA, 621 bp, Homo sapiens
  ENST00000512889
aaacgcctcagtggaaaccactgttaaagcttttggtgtgtttcttaacagtttattcccaggcattgaatttttgctttgttttgcctttcacataatgaacatgtaaaatgtgaagtaggatatgatgtaaaagttatcaataggatcaatcaaaaaaatcattttttagaaattctaaagtgaccagaatctccccctctccaacacaaaatcagtcctcccaacctcccccatgtcttacacaggaaacggtgcttttaaatgtacatccagagtacaaacattgtgtatttctgcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacag

SEQ ID NO: 7000 - DNA, 1242 bp, Homo sapiens
  ENST00000508737
tcatctttgcccagcggctggcgggcaggctgctacaacctccacttagtctaccccagctgcaggctgtaatgttgggggagctgccacatcctgaaggatgaaaaataaatcacgcttcttctgtcgtgttctatttctaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttac

SEQ ID NO: 7001 - DNA, 296 bp, Homo sapiens
  ENST00000513966
tgtgcaatgaagtggcctctttatcaaagaagtttacgaattctttaaccactgttggggccttcagcaatagagcttcactgtatacaagcagaatgacaagggaggtggaagctcattgatatgataggctggacaaaatgcatttgcaccctcgtgtggtccaagttacctgatatccatggactttgatataaacactaggcttgcagagaggtgcgaggtcttaatcaagatggaatagccttagtgacaccggttcctaaggctctattgcaccctcttgttaccctttt

SEQ ID NO: 7002 - DNA, 2365 bp, Homo sapiens
  ENST00000240364
cagcagataagcagcggcctcgggggttggggggctgtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagca

SEQ ID NO: 7003 - DNA, 1522 bp, Homo sapiens
  ENST00000513602
agttcgatccttttggtgaagctagtgggcgccattttgaagttgggcagaaagtgactccagtggtggaacccggagccaaccatttttagttacccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtgg

SEQ ID NO: 7004 - DNA, 776 bp, Homo sapiens
  ENST00000503573
gcgtcccctcccagcttcccctcagggtcccctgtcttgcgactcagcccctgcctgcacaggagcctggaagggctcaaccaagagctggaggaggtatttgtgaaggagcagggagaagaggagctgctgaggagcccagggcacagaaggtccctgccctcatgaggcttatagtcttatggggacaacacattgatcaagccctacagatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcc

SEQ ID NO: 7005 - DNA, 789 bp, Homo sapiens
  ENST00000511743
ctagcctgcatttctctttccatcctctcgcatatcccagaagaaagaggtacttgaagagtttgcaagagatattagtagtacccgtggcggcctgaatgtggctgttttttcctctctgttaccacccacctacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccc

SEQ ID NO: 7006 - DNA, 582 bp, Homo sapiens
  ENST00000503855
ggtgaagctagtgggcgccattttgaagttgggcagaaagtgactccagtggtggaacccggagccaaccatttttagttacacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaaca

SEQ ID NO: 7007 - DNA, 1128 bp, Homo sapiens
  ENST00000514018
ggacagaagagagggtagctgaacaaggttcgggggagcggaaagttgggacccaagcactgtgaggcgtggccaactgcgtcacggtgctcaatcgactgtccttagaaacccgccatccctcctctcccgtttctcaccttccttcgcggcattgccggcggctgcggcccgacggttccgattcgggcagcggcggcagcagcaggaacggtggctccggcgggctccgtggcggcctctgtatcagtcccaatcctgcggacgatccctagtgcctcctgcctctcagcgtctggagcgttctgcgcaggcgccgcgggctgaagcgctttttccttcacttccggctgggtctcgcgtcacctgacgttacgggccagagagggtgctgggaagttcgatccttttggtgaagctagtgggcgccattttgaagttgggcagaaagtgactccagtggtggaacccggagccaaccatttttaccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctcccca

SEQ ID NO: 7008 - DNA, 739 bp, Homo sapiens
  ENST00000505159
agacaccgcccccgcacgcggggaggtgaccgttgagcccaaacaggcggcgtcaccagccaatcaatatgcttccagacgtttcagcgaccaattaataagaacgcctccgatccagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttcca

SEQ ID NO: 7009 - DNA, 714 bp, Homo sapiens
  ENST00000506156
gtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtg

SEQ ID NO: 7010 - DNA, 624 bp, Homo sapiens
  ENST00000515240
gtgctatttatattctcctgtgtggtagaggaggtgggagagatcatctgggagcccacaacacagctgtttgatcagcctagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggc

SEQ ID NO: 7011 - DNA, 572 bp, Homo sapiens
  ENST00000509347
acgcggggaggtgaccgttgagcccaaacaggcggcgtcaccagccaatcaatatgcttccagacgtttcagcgaccaattaataagaacgcctccgatccagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccaggctggagtgcagtggtgcgatcttggctcactgcaacctctgcctcccgggttcaagtgattctcgtgcctcatcctcccaagtggctgggattacagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagca

SEQ ID NO: 7012 - DNA, 528 bp, Homo sapiens
  ENST00000503720
gaagctagtgggcgccattttgaagttgggcagaaagtgactccagtggtggaacccggagccaaccatttttagttactcttgctctgctgcccaggctggagtgcagtggtgtgatctcggctcactacaacttccgtctcccgggttcaagagattctcctgcctcagcctcctgagtagctgggattacagattgtcctcttcatggaaaagtagtacagcatttcttcaatcaattaaaaaaacagttcaaatgtcagatcttgaagtaaatccttcaaaactgcaagagtacactctttgcaaagaaaacctttcttcgccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagatttccaagttgaagcaacaactgcagaggacg

SEQ ID NO: 7013 - DNA, 480 bp, Homo sapiens
  ENST00000514841
atggtataaattgtttcccatgataaaggctggctgagtaggtcaggaaaggtcttgtcagaccatatgtgctgtttcaggctgcttcaaattcttttaggacagtggtggatatgagtgaagacggggcaggcaggccacatctcttagaagaggaaggtgattgccacgtctccttcctccatgctgatggcaaggcgtgcgggctgtgttctcttgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccacc

SEQ ID NO: 7014 - DNA, 2063 bp, Homo sapiens
  ENST00000495147
ggggcgggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaa

SEQ ID NO: 7015 - DNA, 1344 bp, Homo sapiens
  ENST00000370785
gcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaa

SEQ ID NO: 7016 - DNA, 665 bp, Homo sapiens
  ENST00000482240
ggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctg

SEQ ID NO: 7017 - DNA, 2483 bp, Homo sapiens
  ENST00000475361
agattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggacggagtctcactgtgtcgcccaggctggagtgcagtggcatgatctcggctcactgcaacctctgcctcccgggttcaagcgattctcctgcctcagactcccgagtagctgggacttcaggcacccgccaccacgcccacctaattttttgtatttttagtagagacggggtttcaccgtgttagccaggatggtcttgatctcctgaccttgtgatccgcccaccttggcctcccaaagtgttgggattacaggcgtgagccactgcgcctggcctaaatcttacttcttaaactagacttttaaaatgagatgttggatttcacatttcagtattataaggttttctagataccgtaaaaatgtctgaaaaatgcattcactacatatgttactaactttgctcttcaccttttgttgcatcatactaattgatagttgtaattcacagtaccatagactatcaggaagggattcagagaccagctttaccctccttgtttaacatatgaggaaactgaggcccataaatctccaaaatgacgtttagtggcagagccagtactaggaagctctgtttcctgactcctaaactactgttctggccactactaaccaatacctaagctgattaactctaaatgaatgcagcttttgggtcatttgaggtaggagagaatatattgttcacaaaatgaaaagcaaactaagattgaccaaaaaaaaatacattacctttttaaaataggcaggtagaaaaacatagaagggggactctgcatgttgtgctgagaacaagaacattttattcactcaggattttgctctaattctgttgtgggaaaaaggaattatgggacccactctactagtagaagagagcagtagggagaatgttggatttattgaagacaatataaaaagaagaaataggttgcaaatagacgatggaagatgtgtactggaaggaacctgtggatcctctttaatgtattaaatacaccagagaaggagtggacccttccctaatccttaaagccctggaaacagagagatctcagttatcccttcataccttgctttgttctgcaaaggatttttttgttttgtttgtttgttttttgcttatattagagcatagctacagtgttacattccatagcttaagatcctgatgcatgaagtaaaatttgtacagaaagataagggtcactagcatatttctgtagtaggagtttaaagatacagaaaccacaaagtggacggagtccagggactctagtctgtcagaaagaagtaacataggaatgatgtgtgacatccctgagattaggggacttgcccagatgatctgagggcatattttgtgctgttgtagaaaatgtagggcatagtcagagaagttattctgaagcaagaaaaatttagagtaggattacactgagccttagttgaattcattttcacctcagttctcatttgcatatgtatactgctcacttttctccctttttttttccttccttggccctctaatacttgagtacttcctctttctaaactatacctggccagtaaagcattcttttcagaaaggtgaaagtcactagcatatttctttagtaggaattaaagatatagaaaccacaaagtggacagagttcagagactccagtccctcagaaagaagtaacataggaatgatgtgtgacatgcctgaggtcagggaacttgcccaaatgatctgaggggatgttttgtgctgttgtagaaaatatttagcttgctaaacattgttgcacctctttcaagtaattttcgaactttgcttgatgtttcttctatataaagaccctcttgcaccagcatttgcagaattaaattccttaggtttgtttctttcatatcaactctttaatacagtattactgttttaaagaagtatctgcactgttttatgtatatcttgaactaataaaaattccaacgtcaaaa

SEQ ID NO: 7018 - DNA, 348 bp, Homo sapiens
  ENST00000494709
tttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggctgctttgtcacctctgaccttcacctccagccgcttgaatggaaatggttgtcaagcaaataagctttggacttt

SEQ ID NO: 7019 - DNA, 783 bp, Homo sapiens
  ENST00000470657
cttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactggtgaaatggcatttcaatatcaaccaaaaaagattttccaaggcacaaccaacatgctttcttctgatacttcccaactgtcagaaaataat

SEQ ID NO: 7020 - DNA, 749 bp, Homo sapiens
  ENST00000460216
agcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagaagaagtcaaaatcctaccaacattattagaccaagtatccttggaccattaaaaagaaaaggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgt

SEQ ID NO: 7021 - DNA, 620 bp, Homo sapiens
  ENST00000463842
aaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagcagtgtttctctccatcattacaaacttgtgtgagttgcactggttcgccttcaagtcctattcccagtcctatgcaacaatacatcataagaagtcaaaatcctaccaacattattagaccaagtatccttggaccattaaaaagaaaaggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagc

SEQ ID NO: 7022 - DNA, 2064 bp, Homo sapiens
  ENST00000623326
ttatcgcaggctctgaggggcgggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 7023 - DNA, 1368 bp, Homo sapiens
  ENST00000370784
ggcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactggtgaaatggcatttcaatatcaaccaaaaaagattttccaaggcacaaccaacatgctttcttctgatacttcccaactgtcagaaaataatgtgtatctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaagtaaaatgatgtttgacaattatgt

SEQ ID NO: 7024 - DNA, 2119 bp, Homo sapiens
  ENST00000414371
gaggaccacaagcggggccgggctacagatgctgcggctgcccgggcagcgctagcaccgaggacctgacagtcgggtgagggcctgggacagacgcagcagactgggatatgcaaagagaggagtagcctaattgtcaagtctagatctaacaaaagcagtgtcccaagatcatggcatatttccctggaactggaaggactgatcaagaaacacagctagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcattatttctattttaatactttgtttcatgtggaaaaattatctaaggtaattcctttgcaaacgccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctact

SEQ ID NO: 7025 - DNA, 2383 bp, Homo sapiens
  ENST00000615498
gggagagggcgcggcgcggggttcgcggctggcgcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggtactggggggacgcctgtctgtctgtttaggggacctgagaaaccagttagctttgcctcaaacactatagtaccagtcacagagcaatgatcaaggaaggagagatcagtgaccctctgcccagctcctagtcgaagtcaaagtggccatacaggatcccaacaaaagagggggcaagaaagactcttcccattggttctcttcatttcactttcagcaaacatgttcccaattcttccagctgccccttctgtcctcccctattgggcatccactaaacacccatgactcctggggatttcaaatgagcttataagctagggaatttgctattaaagattcctgaatctatgcccatgtacttagagagtttttaccactggattcttccctcccacaaaggaacttcaggaaagcccatctatctggaaattttaaaatatatattgatgttcatagaggagatagctgttctcttccttcaggtgcctcccccaccttctactcttgcatccttctactgctgggcagcaggttgttgaaatcctgtgatcacttggaaaaggatgtcccgttaaacattttaaggagtaagtgatgccttgggagcttctggtttcactaagcttggaaggggtgaaggaattcattttaagtaggctgccctagtccttccatggtaaactctttagcttcatcatcagctccctttctcctctcatccttccaggggttgtcccagactcattagagataattagttatactcaattcaaaattcagcatgtatattacagaacatcctacatctggtcctacctgagaaatgctttccagacccaggctttcttgattttacaagtaaattagttccaggagtatagggccttgtttttctgaaaagcctctacctctgacgtctcaattttcacacttggctacccgaaaagagaaagttgatagtgaattgggggacattgccttaagaggcaaagattgtggttacttgaatcacaggtaaagtttcatcgtttttgttggttttggctttaagcaccagaactataatccacatatcatgaaatgaagtcagaatttggcacatgtcagataactggttcagactacagccaggcctcatttctcgtcagaaaggtcaccttgagatacttactatttataggaactagataattttgaaacttccttttgaactgtgcagataaggaactaagtaatgttttattattcaatatgctagcatttgctctataatcccttttgaaatgtgagaaaaattgtctctgtgtttgaagaatgccacatctttatgcaaaatataatacagttgcaccaagtaaaagttaatgaaatgcaaa

SEQ ID NO: 7026 - DNA, 4761 bp, Homo sapiens
  ENST00000322475
gcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcataaaatatattttttgaatattcagcatttgaggtatggtttagtgggtttatacaatttaaatggcttatataattatttgaaatgaaaagaaaacctagtcagccagaaccaatttggcaatttttccatggtatgaaggcaaatcaattaaggccaaaacgttgaatgtgggagagatagtaagtgacttgtatgagggattactgcataataacgtaacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttatacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagcctcagagtcctttccaacacgaccctccaggcagcagttaccaaccatcagtcttcagctgaagcttcaagtctttgccatccttgtaatgacagccttaggccttgccccaagcattctggactctctaacactcagaattgtaatgtaatattctgctctaatttaaatttttaaaaatatagtctcctaattcaggataaggagtaagcaaactttctgaaaagggctagataataagtattttaggctttgccagtcatatggtctcttgcagctactcaactctgccactgtagtatgaaagcagccatgagtaatatgttaatgaatgggaatggctgagttccaataaagctttattttttttttatttgagacggggtcttgctctgttgcccaggctggagtgcaatggcgcaatctcagctcactgcaagctctgcctcctgggttcaagccattctcctgcctcagcctcccaagtagctgcgactacaggtgcgcaccacaatgcctggctaattttttgtatttttagtagagacagagtttcaccatgttggccaggttggtctcaaactcctgacttcgtgatccacccaccttggcctcccaaagcactgggattacaggcatgagccaccattcccagccaataaaactttatttacaagaacagctggtgggccagatttggcccaagggtcatagtttattatcccttgagctaggctgctgcctgaggttgattcaacatcccagctccagtcaacaacaaaaattctaagtctcccgcctaatgctgctgtggtgtgtcatgccaaaaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaaagtcagtgaggcaaaaaaaaaaaaaaaaaaaaaaaaaaaaggctaatggccgagggctggctccttctttctccctaatcagtgtccttatttcagtgtgctcacatgctcgcctaggactgctttagagtacaactctggacccgccctcatcacagtccaatctaccaaactgagtgaccctaaaggacatcatagacaacatttgaaagcaagaaatgcaaaatgttcccatagcatcaggtgagcagggagaggatgcccactgtagaccacatggaaatggcagtccctccacggagagggaatcacaggaacacatttaccaaagccttcccttccattcctggccattccagtagcatcttcctcatccagaagggcttccaatactctctggaggatcctgactcgtttggagtattatccttgtaaaagatgctggcacattgtaggtgctcaataaatgtgttcaattgaaaaata

SEQ ID NO: 7027 - DNA, 2104 bp, Homo sapiens
  ENST00000280057
gagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcaatggattctccacctggcggatgccatgttgcctgttcctttactgtacacacggtgacaaagaaaagggaagatggagcctccaggttgaacatacctggccctcaggtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtc

SEQ ID NO: 7028 - DNA, 612 bp, Homo sapiens
  ENST00000497449
tttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggaggattctcaaagtagctggtgatctattccaaaccaagtttgggcaagatatgagacatttcattttcaacacactgtgtctgaggtgttgcaagacatccaagtaaagatgatgaatcagcagttgggtatatctgtctggaactcagaagggaggtcttcatgatgacattgcatttgggtactatttacctaaaaatggcaatggaagctctgggagagactaaatcaactgaagatgaggaaatggagactcagagggcacatggctcgttagaggcatgaattgaagcctggatctccagtatgcttcccacctagtgaagttgcctctccaggagctgtctgatctgtaattaattcttgttttctgctcagacattttcttttgcttgaaatgctgctgctgctgtctcaccca

SEQ ID NO: 7029 - DNA, 1335 bp, Homo sapiens
  ENST00000450976
gtcaccggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgc

SEQ ID NO: 7030 - DNA, 1664 bp, Homo sapiens
  ENST00000418281
accggcccggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgtt

SEQ ID NO: 7031 - DNA, 2421 bp, Homo sapiens
  ENST00000340957
ggttccctctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctc

SEQ ID NO: 7032 - DNA, 573 bp, Homo sapiens
  ENST00000433578
ctccggggagcggcggcggacgcgcggctcccacccctcccctctcacgggctctcccctccccagtgtggccgcgaccctaccctctgcaaggcgatggcccgcgccccgagcgcaggctagcgtgcctgggtgcccggccatgggctgtatcggctctcggagcccggcgggtcagggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacag

SEQ ID NO: 7033 - DNA, 812 bp, Homo sapiens
  ENST00000418768
gttcaggaagtcatcaccttctcttgtcagggcatttctggggaccaacagctggccgaggctcagggatagagacggctgctccagctaaaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccc

SEQ ID NO: 7034 - DNA, 4450 bp, Homo sapiens
  ENST00000639617
aggggtgagtttggctgacctcaggactggcctcgagagccctggttaggtaccagttgggggccagggatggcctgtaacctcctgttttccttctggttggtagcatttctggggaccaacagctggccgaggctcagggatagagacggctgctccagctaaaggtcagttgtgatgtacattgcctgttggcactgtctagggaatgggcctcagctccccgagtcccagagagcttggctgagccctggtgttcccacctcctcagagccatgaggcaggaatgttctccttatgtgactaggcacaggttccaaatggggaggggactggctcagcatccggagccaaaacaggaatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctatatacatctggtcattggaggttccagttataaacccatcttagttccacccctttcccctcaaagggggagcaggggtcaagtgaccccaacccatcctgccagggcagggcctatcttcctgcctctggaagacttgttgcaggtgggtagtgggtcagattccaggtaggatgaactgggagaagctggcaccccaggtctggagggggctggggtgcagcctccagctgtagctgcctcctgccttccgaaggcagaaggaatgaaagatgcacattctgggctgacgggcatggctagcaccatcctaggccacccacgaggggctcattggcatttgtcgtcgctgtcggaagggctgccctcccgggggaggccatgacgggagtggggcccccagagtgcatgcacctcagtggtctccgtgtcactgctgctggtggcactgtctcggaagctggcgaggggcggccggactttcacaccctgtgctgtgacagagccctcgatggccttccggagctggaaaggtgagagggacagatgtctggacccagatgtcagactcctccccgccttcctccccaggtgagctggacataagcctccatgactttttggaagtggagcagctttggaggccaccatcacctcacctcctttagagtaacgattccaatgagtctgccaatactggtgacataagcatggtccactcccagcagtgagaagatagtgtgagtctgcagtgtggggagaaaagcgattggacttgatggacgaggggcagctctaaatgacaggccacaggggcccaggacaaggttggtgtggaataggaggggtgccccagattgggagggaaggagacaggactgctggagggaaaataataacaatcgtaataataatgagaatgtttctgtgtccaggcctcaggaacttgatactcaaaatccttatattgcttacactgacggagaaataggatgggggagtaattcttagtcccatgttagaaagggggacgtgggacagaacaactgttcacacgtgaaatctagtgattggccaggctccgtgctaggtcttacattatcatttaattccagtactgtcctgagaactaagcattaggagaagcagcatggggctcaacagtgaagtgacttgttccaggcgggtcctcaggagtggctgtgcagccccagtcacttttcatcacaccggagagggacgcacaaccccagtcctgtttagttgcagatataccgagaagggagagcccacaccgaccttaagggcacttgggccctgaatcctatgcctctcgttccactgcttctcagttgccctcctacctggctggccaggtttggagtctctctcccctgctctggcattccagtcttggcctgaagcacgctatgcctctcatacagtctgccttttctagggtccaagcagcatcccaagttctgttgagatgcagcttgcagtccaggaggacaacggtcacccccatcttcccatgtttttcttgctttaagccctcccctaagctttcacatataatcaccaggggttcagaaattgtcagccagttctccttatgctttaagtagattttcttggggccagatgtcttgaaaaacgctctcctgactcagcagttcctggaatttttggcctatcatttatctcactgttctgagtttacttgtaagcctcttcgcttaatgtttgaatcaagatgagcagtaataacagcttcttgtgtaccaattactcagaactcacttaaattgccttaacactttttaaatgttcttacacatttgaaattctttagggagggatttccagaactttcctaaatttctccacccatggcatgacagtacttagaggggcaagaagttcaattttagaataagctcttctgggcgcgatggctcatgcctgtaatcctagcactctgggaggccaaggcgggtagaatgcttgagcccaggagtttgagactagcctgcaatatgcgaaaccctgtctccacaaaaagccagacatagtggtgcatgcctgcagtcccagctacttgggggcgctgagttgtgaggatcacctgagcccaggaggcaga

SEQ ID NO: 7035 - DNA, 1483 bp, Homo sapiens
  ENST00000383847
gccctggtgttcccacctcctcagagccatgaggcaggaatgttctccttatgtgactaggcacaggttccaaatggggaggggactggctcagcatccggagccaaaacaggaatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgccccc

SEQ ID NO: 7036 - DNA, 3228 bp, Homo sapiens
  ENST00000497070
aatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgctgggcccctggtggtggggggaaggaggacgtcatccatataaaggggatctgcagcccccacccacgcctggccagccagcttctggctcccttttccggcgggcggaggcgctatccggcggcgggccgggaggccgcccccgtgccggtctgctctgctcggcgctgtgccagcaggcggagagctcgcgccttccgcgctgacgtcagcgcatcccgggccgtatcccgggagaccctgttgcgtggtgatgggttgccagggagacatacaccttttctctgggcctgggccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtacccaaggggagggatcgagggtgggcctcaggtcaaggggcagtgttggctgcccttgtgagggacgggaacgtgatagaagagagctgggcaatgccggggagggatgtgtgcctccaacttcattaagtgagggaaacatttgctggggcttgtcagggagccctgagccaggtacagggtggagttaggaacttacgtgcatcagacttaggccttgccatcctgagctccctcgggagacagacaagggcaatgatgggggcggggtgtgtcagagaaaagaagaggctgtcggctgaaagcattatttgcaggtgacacttgagatgggccttaagtgatggcaagcattttttcacgtaaggatggcattcttggcccagaggaaagctgagttccttttcctggaggcaggcgggctgcttgctgacagggattggtggagaagggtttttgttttttgttatttatttttatgtatttatttatttgagacggagtttcgctcttgttgcccaggctggaatgcaatggtgcgatctcggctcaccgcagcctctgcctctggggttcaagcgattatcctgcctcagcctccagagtagctgggattacaggcatgcgctgccacgcccggctgattttgtatttttagtagaggcggggtttcaccatgttggccaggctggtctccaactcccgacctcaggtgatccgcctgcttcggcctcccaaaatgctgggattacaggcgtgagccactgcgcccggcctgagaaggggggttttattgggcagaggagatcagcagtggattcaaaggaggcttggaaggaggcaagggtgtcacagagtgggatccttcagggcctgggtatgatgcctgcactaacctcactggacagtagcgtaggctagacaagattttagagatgtgttgtgaccagctgcactccaggaaaactgtttacattatatcttacctcattcatccagcctttgcatttttgtttgcttgtttttgagacagagtctttttctgtcgcccaggctggagtgcagtggcacaatcttggctcactgcaatctccgcctcctgggttcaagcaattctcctgcctcagcctcctgagtagctgggataacaggcacccgccaccatgccctgcccattttttaaattatttttagtggagatggggtttcaccatgttggcctggctggtctcaaactcctgacctcagatgatctacccaccttggccccttggcctcccaaagtgctggaattacaggcgtgagccaccacgcctggcccagcctatgcattttttttttttttttttttttttgagatggagtcttgcaccgtagcctaagctggagtgcagtggtgcgatctcggctcaccgcaacctccgcctcccgggtcctggttcaagcaattttcttgcctcagcctcctgagtagctgggattacaggaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctcc

SEQ ID NO: 7037 - DNA, 1038 bp, Homo sapiens
  ENST00000453072
ccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctgg

SEQ ID NO: 7038 - DNA, 3677 bp, Homo sapiens
  ENST00000310585
gaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctcta

SEQ ID NO: 7039 - DNA, 523 bp, Homo sapiens
  ENST00000487702
cgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacaggtgagggacatcctgggctagggctgtggtggacccacctgatagaccttggcattctttcagagccacatccagaacactctcagcctttgcaaggggagggagagggacagactcagtccaggcaggcctggacactccagggacaggaaggctgtccacactcatgggtgggaaatgagcagacagaaatggattcgttcctttcccacaggtgctgaggcttctctgcctgtctgcacagttgtgccttgcagtcctcaaaaaaaaaaaaaaaaa

SEQ ID NO: 7040 - DNA, 1054 bp, Homo sapiens
  ENST00000510362
gtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagta

SEQ ID NO: 7041 - DNA, 3145 bp, Homo sapiens
  ENST00000399793
atccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggaggagcactttttttccaaaaaggaaagaacgtctctactgggtttttttcctcctgatattcagcattagagtagaaaagaaactattgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaa

SEQ ID NO: 7042 - DNA, 3268 bp, Homo sapiens
  ENST00000306320
accgccgccccgccctcggcggcacccacacccaggcgcgcccgcgcgcgcgcccggccccgtccctgtctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggttccttgcattgactccatggagagtatatcacctgatttccgtcatgatacttgggcgtgttattatgcaaataataaaggatatggttttgtctagaacaagaggtgcacagttgtggagaagcctcagtgaaagctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagcttgcaacagagcacaaaaaacaccaaaaaaatttcaaacaagaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaa

SEQ ID NO: 7043 - DNA, 640 bp, Homo sapiens
  ENST00000509977
agtgtcaggctgcccctaaggacagggaagtcctggggagaaagcgttttgcccagatgaacacgtgaactcaacattcgtgtgcatgcttccgctgggaagttatcaattccaaaccagatgaaagacccaggctcagccactgtattgcagaatcatggatgaatttcagcatatttcttcaagaaatgtctctttttaaacagcagagccctggcaagttttgtctcctggtctgtagtgtgtgcacattttttacgatcttgggaagttacattcctggggttatactcagctatctactgttactgtgtgcatttttgtgtccattgtttaaatgtaatgatattggacaaaaaatttacagcaaaattaagtcagttctgctgaaactggattttggaattggagaatatattaatcagaagaaacgtgagagatctgaagcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatct

SEQ ID NO: 7044 - DNA, 585 bp, Homo sapiens
  ENST00000506441
attgtttggccacattagccgtggttagcaggtgctgcagcctttgccactgttattatttttaaagggcagaaatgcctgaaggtgaagactttggaccaggcaaaagctgggaagttatcaattccaaaccagatgaaagacccaggctcagccactgtattgcagaatcatggatgaatttcagcatatttcttcaagaaatgtctctttttaaacagcagagccctggcaaggcaagttttccagtaaaggagtatgttttaaaatgttcagttacttggaaacaaatgaactaacctattttatcagcttgtcagatttctccaattttaaatataatatactaagaacatatgccataaaagctggtatcagcaaggttcagatgtgtgagtgtgcgaacactagataatcctcagcctcacattgtgaaattggattggttttacattttatatatatttatctagctcattagctaaaatgaatggtgattggtcttatcagcaagactagggagaaaacagtcttaagaatttcagttatcgtatttagcctggtgctgaagtcaaagggagatga

SEQ ID NO: 7045 - DNA, 807 bp, Homo sapiens
  ENST00000509048
ggcacccacacccaggcgcgcccgcgcgcgcgcccggccccgtccctgtctggaagcacagctgaagatggcgagcccggcgcctccggagcacgccgaggagggatgcccggctcctgccgccgaggagcaggcgccgccgtcgccgccaccgccccaggcatcccccgcagagcggcagcagcaggaggaggaagcgcaggaagctggggcggcggagggcgcggggttgcaggtggaggaggccgcgggccgggcggcggccgcggtaacctggctgctcggggagccggtgctgtggctgggctgccgcgccgacgagctgctgagctggaagaggccgctgcggagcctgctcggcttcgtcgctgccaacctgctgttctggtagacactcaccgcaactttcctccggacgcacgtccctgtgagcagttgtcgttctccgtgtgcggatccagcctcagatgcgaggtggtcggccgaccctcaggcacctgcacctacaggtgttcccatcgtgcttgaaaacttcgcccctgctttctaaaactctgaggtcttgacctgctcgcccaagcttgccggagcaaacgtgcttgaacgtgtcttggttcttgcagccccagcaggcatatctggaccagattaggtacccgttcaaaacggtgccgcattcatcagtcacctgagatgggccctgaatgatttgttttttccttcccctggagcgttaggtttactgtgtttactccctgatgagaaaacgggaggcaaacaagcaggtggagtatgcccagcacccac

SEQ ID NO: 7046 - DNA, 6962 bp, Homo sapiens
  ENST00000395297
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagccactactggcttactgagagattactccaatttaactagacttgccgaatatgttactagcttatagctttatcatttctgattaagtgcacacaagcatttcagaactcaggttaatctctgtgcagcagtggaacatatttgtgtaaatagaatcctcaatagattcaaatgtgtcagttgttcaagaaaatgtgatgcccatattcatattctctcctcatgttttctaaacaagggagcaaggaatgtgttacaaatcccagttctatttcataacagcagtgagcagggtgacttaaggtaaagagggataaaggtgacactattggtaaatacaagtttgttacaaagaaacatgactctagggacatactgaactatgaatagttgctccacctacttccccagaattcttctatgcagagccctgatccacaaattattttagtgattgcttacatctttgtctgtagtagggaacactgagtgagactaacctagcagaagggggcactgagatgaatgcacacacgtgtgaagctcctgctgatacacttccaaagacatgctatgttagcatttgatgcaattgcaaaaaattaaatccattaaagtggccagctgcttctcctctccatggaaggaggaaaacatctaaatggaggagtgctggattaaaacctcaggggagctctaagaagggtgctggctatctttcaatagaaatgtcttcttgccttaggaaaataaagggctaggaaaggtcactgcgttgataaaaaccaatagacgacagggacaaaagtgagatcagataggaggagaacaaccagactgaagactcaacataagctgttattggtaagtgactcaaaggggagttttgaaaattaccaggatgtttaatagtcaggtctcaaagactgagtatgttgtatgggctaaagtaagcctaaagaatcatttcgttgtatggaagagatgaatgaacctggacagtagggataagtaagacaggagcctaatcttttggagatgaaagctcctgcttctgcaaaaatcccttctgaagtgtggaaacgcatctaggaccagggttctcaatacctagaccatgactctaggtcactgatgccatggtaacaaaaccaagtaaatctaagctcatttgagaattttagatcctcttatgttaacaatgtgactttgaaaaataaaagcagaccatgggaatgagtccagatgggcagctttgcaggagtgtagacatgtggtattcttttgaagaaagagagggtcgttgagggagagttgaatgtcttgcaaaggcagagttccacacaatggatttagggtttctcagtgagtcctttctaaatgcttgttatatcctggtcataatgcatatgggttcactgagtcctctggtcactttccactggggatttttatctgagctcccgagtcagagctgggcatagactctggttcttcatgaggagtgctgtatttgctctgtaacctgggagacatttgttccctagtcgtgcagcacatggtattgtgtttcctgacctaggcaagtgcccatgctcagtacagaaccataagttggtagcagcttctcctttctggccaaatgatgggccctgtccctctgatgagtgcatttcatgttgtgtttccaattttcatcagcaatgttcgtcattccctggtcctttgaaagactgtgtagcccgcggttatggagccgggatgaatctgatgatcatcatcttctccaataaccagatgccatttttaacttcaatatgctgtctggacatagtgagaactaatggcaataaacgtccagctgcatggtgcacctcttttttataggggtgctctgctgtctttgtaaaccctctctggcctctgagcatctattataattgtgtagaaagtacatctctatattgtaaataagagtgtcgagtgttgcgtgtcatgcctcatttgaaaaggcttttttatgtctctttctattgaaatatagatatcgaatatataaatatatatacataaaatatatataaatatatattatgtaaaacagggacattctattattgattgtaaaaattataaacaaaatgcctgccaagataatggtcttgtatgtcttcattctctgcgtaatttttgtttttgtttttatgatttgttgtttcccaaaatgagttagaaataaaaatgcccaatattgagattaa

SEQ ID NO: 7047 - DNA, 4734 bp, Homo sapiens
  ENST00000482951
ggagctcttcacccagtgtagggtatggtttgtgaaggtatccctagagaaggtgactctgcggctgagcttgaaggaagagaattggtaggtgacaaagaagaggtaatgagccaaaaagatcatgtctgaaatacaaggaacggttgagttttcggtagagctacataaattttataatgtggatctctttcagagagggatgcagtctgaatttggcatttcacgtgcaggtgatatcagtaaatcctcatgatagacttacctccaaggctcattgtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtagtggctttgagggagcaggtctttggtaatgcttacgatcggtggagagctttagctgagacctgcttttacagacctcaccatttcagaatgaagcttcaacagcattgggggacggaggctcgggtggaacctgacatgagaggtgcttttgttttggagattcgagaaagctgagcaaatagactaaatgacaacaaactttgcttgaatttgtatagttacctggagtgtcattcaagatgttttctaggaaaaatatgagagaataaacagaatacttgggagttggtgagctccccttgctagcca

SEQ ID NO: 7048 - DNA, 4288 bp, Homo sapiens
  ENST00000276737
aacaccagctcgcaggtgctgcggactccccagtccgcccgccgccgccgccgccgcaactgttggcggccagagacggcgaaagaggagagagagggacccaggagcgcggcccccgggggagagagaggggagccctgcagtggagacaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagttttactcgtccaggaagaggctcctggcttggtaaaggtggcccagacaccggacaagaacagtctatcatttctctggaaaacttggtctttggagctgggtactgcaagccgacttcctcagagggaagcttctacatcacctctgagaactgcatgcagcacgcacacaagtggcaccgagacctgtgcctgttgctcctccacgcttaccggggtctccgtctccacttcctggtgatcatgcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtccgaaggttttctgaggccttcttttacatggagcaccaaaaacttgcagtcctgacatttcaggagaatctgatacagacgcacagccagctgtccctggatatccggaactcggagtacctcactagcatgcccccgctgcctgcagagtgcctggacatcgacggcgattggaacaccctgccggtgatctttgaggacagatacgtggactgccctgcgacagggcataacttgagtgtttatcctaattttgatgttccagtgacaagtcctacaataatgaatctgaaagacaaggaagataactgtatggtaaatagcaatttatcttttagggaagaccttgtcttgtctaccataaaaccatcccaaatggattctgatgaagaagttataaggtgtccagagccaggtgagaatgtggccacacaaaatcatatggacatgtgctctgaatctcaggtgtatatatcaattggtgaatttcaaaacaaagcaggtgtgcctgaagatgaatgttggactggccaaacatctgatgctgggacatatccagtggcagatgtggatacttctagaaggagtccaggtccagaggatggacaggccccagtgctgacctacattgacgtaaaatctagcaataagaacccctccagagctgaacccctggtggccttcaatgctcagcatgagagtaggagctctagagataagtatggattagacaggactgggctaagcaaagtggtagtaggtggaagccaccaaaatgccatctcttcagacaaaacaactctccatgaattaagtactctaggaaagggaatagatcaagaggggaagatggtgctgctaagcttgaaactcaccccctctgagccctgtgatccactaagttctaccctgagggagcccttagatattaggtcttccctaaaggactctcacacagaagagcaggaggaactctcagtgctatccggggtcatcaagagatcttcatccatcatatctgattcaggcattgagagtgagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattagcttcattggccattctcttggcaacatcatcatccgatcggtcctcacacggccccggttccggtattacctcaacaaactccacacgttcctgtcactctctgggcctcacctgggaaccctgtacaacaacagcaccctggttagtacaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacaccctgatcggccgagccgctcacatcgctgtgctggattcagaactcttcctggagaagtttttcttggtggcaggactcaactacttcaagtag

SEQ ID NO: 7049 - DNA, 1616 bp, Homo sapiens
  ENST00000467365
gagccaagctccgtcgcctggtcagaggcccgaagcagggctctggagttgcccagtgatcgggaagtcttgcacccgtttgttcgaagacatgccctccaccggaactccctagagggtggacacacagaaagtaacacaagtttgccaagcggcatccaggcttctctcacctccattagctctttaccttttgaggaggatgagcgggaggtggcactcactaagttaaccaagtctgtatctgctccccacatcagtagcccagaggaggctgctgaagatgcggacaccaagcagcaagatggaggttttgctgaaccttcagatatgcacagcaagagccaaggttccccaggatcttgctctcaactttgtggtgactctggaacagatgctggagcagaccatcccctggtggagatagttttagatgctgacaaccagcagggccccggatacatagacatccccaaagggaaagggaagcagtttgatgctcaaggacactgtcttcctgatggcaggactgagaacactccaggtgttgaaaccaaaggtcttaatttaaaaataccacgcgtcatagcacttgaaaaccccaggaccagatctcttcatagagcacttgaggaaaccccaaagggcatgcctaaagacttgaatgtgggtcagcaagctctttccaacagtggcatctcagaggttgagggtctctctcaacatcaggtgcctgaattgagctgtacgtcagctgctgatgccatcaacaggaactcaacaggccagcaaagccaaagcggttcaccttgcattatggatgacacagcatttaatagaggagtgaatgccttcccggaggctaaacataaagcaggcactgtgtgccccactgtgacccattccgttcattcccaggttttgaaaaaccaagagctgaaggcaggcacttccatcatggggtcccatctgacttctgcagagacctttactctggacagcctgaaggctgtggaggttgtgaacttatctgtgtcttgcactgccacctgtctccctttctcatctgtgcccaaggagacccctgccagggctggattctcttccaaacagaccctgtttcccatcacccatcagcctttgggatcctttggagttgtttctacccattccagcacgttggatgaggaagtcagtgagaggatgtttagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcagatggacacatttgcagattttgatactatgacggatcggttattggatgaaatcattcaacacattcagttgtacaacctctccatatcccgaattaggtaaaaggaaaccacaggtagttaatgctgggggaagaggggggacatttttgagtgtttgctgtataaaagcaataatatgatgccttctgtataccactgagctaagctaacttgtgacttttaataaattacttttaaagcagaagtaa

SEQ ID NO: 7050 - DNA, 585 bp, Homo sapiens
  ENST00000395295
agcatgttccctgggggctcaagtcagctttgccactcagcaggcactttgcttgtgggtgctcagcccttctacataccagcccagctcatttcctgttcaacatgaagtacacagcttggcttgtgattaattagtgtattctccagtttttatcaggccaaagaaaaatttaaaaaagaactgaagattgaaggatttctgtacagtgacttaactgtactagcttctgatataccatatttcccaccagaggaagaggaagaaaatttggaagatggaattcacctggttgtctgtgtccatggcctggatgggaacagtgcagacctccggctggtaaagactttcatagaactggggctccctggaggaaaactggacttcctaatgtctgaaaagaatcaggctggagtgcaatggtgcgatctcagctcactgcgacctccacctcctgggttcaggcgattctcctgcctcagcctcctgaactacagatggacacatttgcagattttgatactatgacggatcggttattggatgaaatcattcaacacattcagttgtacaacctctccatat

SEQ ID NO: 7051 - DNA, 558 bp, Homo sapiens
  ENST00000160713
agaggtgctttctctctggacagttttatgaatacataaggaggttctgtccccactcccttcgcaaccgcatcttattggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccg

SEQ ID NO: 7052 - DNA, 547 bp, Homo sapiens
  ENST00000517849
gatttgggagccaaaggaaggagctcttcacccagtgtagggtatggtttgtgaaggtatccctagagaaggtgactctgcggctgagcttgaaggaagagaattggtaggtgacaaagaagaggtaatgagccaaaaagatcatgtctgaaatacaaggaacggttgagttttcggtagagctacataaattttataatgtggatctctttcagagaggaatctattaaatgtccatgaggtgatatttgtaaagcacctagtaaaatagaggcccaggttttacagtacaagccaagaggacccaagccctctatggactactccattgattgtaattgagactctgaaccaaacatcctcagctggtcagtgccagggctagaacagactgtcgatctggtcaagctctgaatgtatgttcctctctacattttatgcaggtattaccagatccgagtgaccttgaaggtgtcttcaaggatcccccacagactgagtgcctccatcgctgggcagacagagagcagcagcctgcattcagcct

SEQ ID NO: 7053 - DNA, 684 bp, Homo sapiens
  ENST00000520380
attgaatcaatacagcctgtgtttctcatgatcgcctggtccttgagactgttgataaggcattagagagcttcatggttgttgataatctgaggaacgccctctctagtgacagactgtcacggacatggaggattttttgaagtgccttttcaattttatgagttgaggatcctgcagccctggagatttataattgtccctgccactgctgctttgtgccttcttctagtttctgccttgtttatctggttttcttcccccatagtattttggcaattgtgaaaagtggttctggagaagtaccaacaaatgctcttactgcccgagaactgacacttttggaggctactgatgtttacggcaaaatagcctgagtcctttaatgtccttctttgattgttctaccagctacgattcctgcaaatccctgtcattcttcatcacaaagttatagaggtaatgagccaaaaagatcatgtctgaaatacaaggaacggttgagttttcggtagagctacataaattttataatgtggatctctttcagagagggtattaccagatccgagtgaccttgaaggtgtcttcaaggatcccccacagactgagtgcctccatcgctgggcagacagaggttctaaatatacatatgtcagaacaagaaccagcacaaggtaagta

SEQ ID NO: 7054 - DNA, 378 bp, Homo sapiens
  ENST00000520954
gtagggtatggtttgtgaaggtatccctagagaaggtgactctgcggctgagcttgaaggaagagaattggtaggtgacaaagaagaggaatataacacattcctgtcattaagagaagctgctgacttgaaatgggagttcagtaatggcagtgagaggagatgaagtaacaccgttggaggaggtcagagcacagggtgccttaaaaacaagccacagcatttggactttattctccttatttatgccatcctgtttatcagtattgatctgcagcactccaaggtccaagggacaaaggcaaggaaatctccaacctctcagaatatgagaagatactatagtaaatatgtcaataaattttattctacaacagc

SEQ ID NO: 7055 - DNA, 5067 bp, Homo sapiens
  ENST00000520283
aagagggatctgtggtgatttgggagccaaaggaaggagctcttcacccagtgtagggtatggtttgtgaaggtatccctagagaaggtgactctgcggctgagcttgaaggaagagaattggtaggtgacaaagaagaggtccactcatatgatcgaatttgaatcaaggtctcaagctaatctaaggaaaaaaaaaaagcagagaagctatatggcagaaagcagagaattggaagggaagtcacaaaagaagagaacatacttgcaggcattgtttcaggtagtgagtgaaatctgcaaacaaacagaaattctttctctcgtggaatgtatgtactaactggagaaagcattgtttaaaaaataagcaaataggatgtcaggctgtgttcaagagagtgtatttagttcttcacacaatagtgatgctgatggataaagatttccagtttggtctcaatccaataaaacacccccattcaaagtgtcattgtcccactctttccaactgatgccctaaagctcacagaagagacttgttgggtgtgcaaatttggctttcctcataattctgcaacctgcataagaaagttttagttctgattttcagccttatcttccctgtgactacatgaaataagagattattttagggctaccccagaaacaaacttgttctctcatcagagctgagttgatagacagtctgaaggctagatcttgttattttcctctgtttactctccagtgctgtaaaaaatatccatcccagcatgcttgtattcatcattaacattgtagccacgtggagcagccactcggtcatccaaggcacttgctagagtgagcacttcctccactgaggctggagggtctacgatgacttcactcacatgtgtgggggtcttggtgcaggcgctaactgttcctctctttctttaaggtctgtgtttagtattctagtgtaggctttgttacatagtggcaggaacactccaaaatagcaaagtagaaggctcaggaactcacacagtttcacttctgcatattcagttaccacccagaccaaggggcatggaaattggctctacctcttgagttgcatgtcatgaaatatcatagccactttttcaatcaattagaggaagcctacagtatgagtatatctcagaaatgtgatagattttaaattgatcttgcctttctaaagatgtttcccatctatactctgtgagagacacctctaaaatatctcatgtcaaaaaagtattgggtaaggtgtccagtaacctaggtttgtggtctggctctggaactgatttatgttatcttgtaatgatagcaatgatgatgattttggtgatgacggtgatggtgattttattagatatgatttagacaatgcagttagtactttcatgtgcattattataaatatttaaattctaattttaccttttttggacttttgtatgtattatctgttaaatataaagcccatattttacttttgtcctagatatttgtcactatcttgcacccatttctccctcctaatagcacccagacattcctctagatgaattgtctcttgaatgtatgctcttggttgaaagtaaccccagaaatatgccttcttctggggtggcttaagggttcctgagacatttatttgcaagagcatagccaaaagctggggcgatgaccttaatatggccaggaagctacctctcacctggaactttaagtcttaactgagatgagtcaacacaaaagaaaacattatagttcctgcagcccagtggtgggaacctggtgagcttgtcaagttctcactgatgagactggcaagaacaccctgatagctcttagttcttagccttgttcatcacactatcttccctatgatcctcgcacctgcactccagttctccagtgggtccattcttgcacaggtaagccaggattagtgttggcatcccaggaaccatgactgcttcagttatctattgaattactttagaagtacctggagtgatggaaagtgcttggccaaagtttacaaagccctgtagccaataactggttccaaatttcaggtctgccttttctgctcacatttcaacattggacagtcaaactttctaagcacgaatttcttcagttgtaacatgggacacaataatacatccctagcagaggggttaggattaaattagagagcagctgtgaagcacctgggagagcttctggcacacagtaacagtggaaagttctggcactacagtagaaagttctttccctttctgttaatgttaatgcttcatccccattcacagagactggagtatcccttgactactccagtcaaagggaaacccaacatgacatgttccctccccctaggaaatgtcctcctctgatgttatgaggtcggcctatgaagctttaccttggagtttgaagatgagactggtgtttgtaacccatgaggactactgaggtcacatggtgtagtggaatgagaatgggatttgggatcaggcaggtctgaattcatacctaatgatgacatatgtgattagctgcttaatcttgaacgtcatttattgtcctatgtgctatgattctctcatattgaccacacagggccattatgaaatgataattggtaatttacatgcaggttctttgtaacctagaagaatattatctttgtactggagcctcctcaaagattttcaggtatatacacaccagaaactttgccttgtacagctcctggtggataaatgaaggccttcaaatgggcaggaaataatccaatttccatgaaagttaattgagctctgtgttttctaaaggctaatagcctggtgagagatgtcctgagtcaagctaatgtgatgacccacttgtttttttaggtaccagttatggaacagaagccacatctgtcactgataacctgtttgtatagtgacctcttccaccccacccacaaggttgccatggcaattttaggtcaagaagatcatcccattgaaagacaggaaatgctaaggagtaaaatgcagtccccaggaaacctggttttagtccttgctacatattattaaatggctggtccagtatctggttgggactactgtgccaggcatcatcctcaggtgatgtctgatcatcctggcctgtctttggcaagaatccagttcagtgggttttgccagaatccttttacttctgaggttttctcttagttgttttccatcctctgatccctctcttgttccttggttatatatttccccttgcttgtgctgtattcaaaattgaacccagttttatattgaagcatcttttctcctgtttcaataatccagaatagagtctgtttctaccactttaactactgcctagctctgtttttttctttgatagagctcagaagtgcaattcaaatttgatttgtagatgtagcagcaatcaagatttagctggtatttgaagacactcatattatcactctttctactaccctttattatattttttgattctgccccacattatttttgctaaggaaggagagttccaggaactctcatggagtacttgagacatggctcttcaatagccacccggcaccttctcttagataagaggtgtgaaattataggagctccttctcgcttgagagccccttgagtaataattatttaaaaaaagctgttataataaaactttgcatttaaattgcctcttattcttaggatgtcaaagtgctttacaaacatgaattgctagaaaccttttaggttaattaaaatgagcaggtttcccagacaaagaaggtgactgtttttgtactctcgggtgtttttacaggtgagcgaattgaagcacaaataagttctttgactaatcaaatagagatgttctgagaacaggtgatttcagcattagcacatcaaccatgctaccaaatttcattgcccttcggaattataatgacaataatgtagtgattcctgaattctggtattcttaataagaatatttgtgctactatttactgaatggctgcagtaagccatgcattatgcctggcactgggtttgtggtagtgtgttgtgttctcacaatgccactgtgaaataagtcttatcttcactttatgctgctgtaagataggatttatcctcactttacagccctggacactcagtttgaaagcagctgagccacttgtcacgggtcctgcagctaggaaatggcagagtgtattagtccatattcacactgctatgaagaactgcctgagacggggtaatttataaagaaaataagtttaattgattcacagttcagcatggctggggaggcctcaggaagcttacaatcatgacataaggggaaggagaaacaaggcaccttcttcacaaggcggcaggaaggagaggtatcgagtgaagggggaagagccccttataaaaccatcagatcccatgagaactcactcattaccacaagaacagcatgagagtaactgcccccatgatccaattacctcccaccaggttccttccatgacaggtggggattatggggattataattcaagatgagttttgggtagggacacaaagcctaactatatcacagagctagggttttaacccatgtttgtttgattgctgtgtctatattcttcttctctaccaatatcattaccaaacgttattactttattcttctctatttctaaacccctgaggaatataacacattcctgtcattaagagaagctgctgacttgaaatgggagttcagtaatggcagtgagaggagatgaagtaacaccgttggaggaggtcagagcacagggtgccttaaaaacaagccacagcatttggactttattctccttatttatgccatcctgtttatcagtattgatctgcagcactccaaggtccaagggacaaaggcaaggaaatctccaacctctcagaatatgagaagatactatagtaaatatgtcaataaattttattctacaaca

SEQ ID NO: 7056 - DNA, 427 bp, Homo sapiens
  ENST00000523049
aaaggaaggagctcttcacccagtgtagggtatggtttgtgaaggtatccctagagaaggtgactctgcggctgagcttgaaggaagagaattggtaggtgacaaagaagagattgaagacgactgattgacagagcctgagtcaaatgctaatgagcccttgctgagtaaggaatgagaaggatgtttggtgtcccaaagaccataaaactcaacaataagaaaataaccaaccacattaaaaagtgagccagaaattataacagacacttcaccaaagaaaatgtagatggcaaataaccatatgaaaagaagctccatatcatagtttatcagataaatgtaaatgaaaacagcaatgagataccaccacacacctatcagaatgaccaaaatccagaacatcaacaccaccaaatgctggcaa

SEQ ID NO: 7057 - DNA, 4094 bp, Homo sapiens
  ENST00000284486
aaaggagcagcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactataaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaaaaatg

SEQ ID NO: 7058 - DNA, 1325 bp, Homo sapiens
  ENST00000531564
ctgcccctccctctgtgctggaacctccccaccctgctgtccaccccagctgcctgccactccggggaccactcttctgcacacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactataaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataaga

SEQ ID NO: 7059 - DNA, 1642 bp, Homo sapiens
  ENST00000534308
ctcctgtggagtggacgtgcccgcctctgagtggcagggcagggatcgggactgatgcggttctcatccctcccacagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaa

SEQ ID NO: 7060 - DNA, 801 bp, Homo sapiens
  ENST00000527445
tttgatcagaccatgaaacatcagtgggttcttgcagaagtgatttctctgtgtgttcatcagtctgtcctctgcactgtggcttctcgcatcttccaggaccctagacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtg

SEQ ID NO: 7061 - DNA, 1620 bp, Homo sapiens
  ENST00000528897
gatgtagaaacggctgctggaggacaggacctgtggtgggtggaggtggtgagggggcagtggcacctggacggagcagacccaccttagcctgtgtggggtgcggtttccctgctggctggctctggggaccccccggctgttgccacagagaggaaagacctgtggcctcagattcagacagcctgagcttgtccccacaacttattgctgggagatctcgggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggc

SEQ ID NO: 7062 - DNA, 1120 bp, Homo sapiens
  ENST00000531804
gtgagaatggcagactggagccctttgaaagacgcttccagccccgggcatctaggaaaggtgcttgatgaggtctgggatgaagaaaatgagacttagcaagcctgacaagacgtagagctaggccatctgatcccaactctagtgtctgcatctggagacagtggttctccaccccggctgcacactcggatcatcgggggagctgaacactgctgtctaagtcccatctctcgaccaattgaatcagaatccagttcctcagggggattctcgcttgctccaagcagagctggaggtgctgccatgcgggcacttaggtgaacacgagaagcctcgttctagaacaatgagtcacagcctgcttgtttagccatccagcccaggtgccaccgccttcttccctccacagctgcaggtttatttgcttctgtctctgaagaggtgagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcatacctggcccttcccgaggccggctgcggagccacaggcgagcttggaggagggggagcgtggggggcaggagcccttgctccccctgagagaggctgggcagcacc

SEQ ID NO: 7063 - DNA, 712 bp, Homo sapiens
  ENST00000528111
ggggaggcgaggcgggagccctgagctgaggccgggcagcgcggacccgcgcaggaggaggcggcggggacaccggcgagtccccagcagggcccctgggctcccggaagatgaagaaaatgagacttagcaagcctgacaagacgtagagctaggccatctgatcccaactctagtgtctgcatctggagacagtggttctccaccccggctgcacactcggatcatcgggggagctgaacactgctgtctaagtcccatctctcgaccaattgaatcagaatccagttcctcagggggattctcgcttgctccaagcagagctggaggtgctgccatgcgggcacttaggtgaacacgagaagcctcgttctagaacaatgagtcacagcctgcttgtttagccatccagcccaggtgccaccgccttcttccctccacagctgcaggtttatttgcttctgtctctgaagaggtgagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctc

SEQ ID NO: 7064 - DNA, 5826 bp, Homo sapiens
  ENST00000304698
acatgcgcgaggatgcgaactccccttccctcctcctccgccccctccgcctcccgggcctcttcctcctgccggtgagggagtgcttggcagattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttgggtaaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtcctcagaaaaaggaaccatcaaaggcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgaacagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattctcatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaggacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacgtaaatcctacatttatataagatgggcaagaagctacttggtcattagagagggagacaccagctctttggttgtttttggatataactttacaaaataagtaagatgttaatttagaaatttgagaaattaatgctctaatactgagtttttatttaaaaattattttttcttcccctcaacaatgaagcaagcttagctgtcaagggaaactttttacaaatctgaaaaaaacaatctatgactttggtttaaggctcactgatacttttaggctaaattggttttaatatatttcttctattctaaaaacctgaactcagtcacttaaaggctatgaaatttaaaaaaaaagtcgatgtgaaagtttcttttgaacactaaaataaaatatgtgcagataaaatatacattgatttgtttttcttaaatgttgatgagaagaaaaagagatgccattttcctgaggctcaaaaataccttcaggatagttgtatatccagttattgattttcttaaaagatgtgtaaggaaaacagtttcaatttcaggggaaaagtaaaagtttttccctaagtcacttaaagcctttgcaacttcttttttcagttttgtaagtaatatatctatgttcttttcattatagcaagcattcaatgtgaacaactttttaattaactctgaattaccattcatacatcctaaaaataaaagctcgttattcattaaaatcaactgatcccatttttcttaaaatttccctgaaggcaaatgtctgaagcacctttcccttgtgggggtaaaaatcctaaattgctttatttttcattccctcctattcaacatgggagcagcatagagacccaaaccatgtaaacaagttcagtgaaccaaaacagccacattagcttcagtaaaattatagctagatgtgcaattttttcctccaacttctaacgtgtcaaataaccttcctactgttctgtgttaactgaaagaacataaagaccctaggcaaatatttgctatatattaccccaatccatagaagaaataatgttttgggtaatacctaggcttcctttttttttttttttttttttttttagtgataaggctcataacaattaattagagaaggcttcttattggtcttacacagaaagatacatcaaaagcagcatgactcaaaatgatttggaaaaggttaaagttagtgctctgctgaagtgcctttgatatagacttgcattattagaaggatataacatcttttttaagtgtgcattttctttcagttaaccaaattaaacagatgtgcagttttattaaaaatatagacctagtgtttcatgttggaacaataaatattgcatgtgagtagtatttcttgttttttgaatacagtatatattgataaattgtttatgttggaatgaagttagaaactatatagcaaaacattatattttaagtgtttatttttcccacctttaaataaaaatgtttcatctcagcttggtaatgaaatacacatattggtataagggtataccattcaggtatgccacttattttattcatttttgtgtaagggaaatgagatgatgtatcccaagggcttttctagaactacttgtttgctttcagaataaaaccttattattttttacactgcacatgctgttctcaattggtaattataggcaatttatcttttctaatgatcaaaagagtgtgacttctcatttgtgagtagttcacaaatttcctgttaaaaagctgaaaccatctactttttcttaacccaagtgataataaacaatattcacaactttcttaaatttttaaattgaaaaccaaggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgtacttgga

SEQ ID NO: 7065 - DNA, 940 bp, Homo sapiens
  ENST00000612606
cgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactcaataaaccaggttttgaaaacattgaattgactcctcttgctgcaatatgtgtgaaaatatattctggaggaaaagaactaaaggtcaatggctctattcaagtttctcttcctcttctacgtctgaatgatat

SEQ ID NO: 7066 - DNA, 720 bp, Homo sapiens
  ENST00000401723
cttggggtgcttcctgtttctcagtaaagtgaagttgcggcgacctcgtgcctgccttatgtgcacctgtgccagcatctttctcaggtcccggatgttacagagaagcctgccctccgctgaaagaagaggaccagaaggagatcggcaccaaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttga

SEQ ID NO: 7067 - DNA, 493 bp, Homo sapiens
  ENST00000420297
tttcactccggctggccctggctcatctccttgaggaggaagtgtgtgtcctctcctgcacgcctctccttcctggggagccctggctcacagctggagccagcaggcctggaggctgcagaccctggactgggacttgttgcttttgagagctcccctgaagcctggctcctcaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactc

SEQ ID NO: 7068 - DNA, 12691 bp, Homo sapiens
  ENST00000379558
gtttattcaaggagagctttgctgagagctggagcacgccagcagtggagctcgtggccacccagcccctgctcagacaggaggctgcggcccaggactgtgtggctggtgggggccagggtgggccaggcctggggctgccccgtccttgcctccctgggcccatgagcatcaacgtctctatagagaccaaggaccctggattcctccagtgacaggggtttggcctctggacagagaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccgagcctctctggatccagggggaggcccccaaggagttcccctgcacagcaccatcccccgagccacctctcagaggctgctgagggtgcccaggccgatgcctctcatccagagcatccctaccacccctgaggccagcggagtcaaagagaagggcctggacctaccggggagcattccgggtcctcacgagttgagacccggtgctcaggaggcgcagatctcctggcaatacctgcactgcaatgatgagaagatgcagaagtccctgggcgccatcgtgatcccacccatcccaaaggccaggacggttgcagcgaccccctcccgtgtgcctggctcccttcccagcccgttacctccaggccagggagtcctcacaggcctgagggccccacgcacgcgattggctcgggggagtgggcctcgggagaagacccctgcatctctggagccaaaacctttggcctcacccatcagagacaggcctgccgctgccaagaagcctgccctgcctttttctcagtctgctcccacgctgacagccttctcctttgactgtgccagagaagcctgccctccgctgaaagaagaggaccagaaggagatcggcaccaagatccaagtcaccatctccaagtctgcccgggagaagatgcagctgaagcagatgaaggagatggagctgcttcggaggctggaggagcccaggacagggcaggagctcacttcccagtgcctgggctcccagagagccttcatgaaggaaggcctccttcccctccggggcagcgggacactgtctgtgcccactaggctgagcggcccatgcagaaacgacgtcagcatcatcctgaggaagtgggccagccgggcctccctgcccagcatccccatcagccggcaggagccccgctttgcccgccacgcctcagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaaggttttattatcttgtacttttttaatcacagagaattttccagtaactaggtttgtgatgaacgaaatgaaatgtgacagcagcaaaaccagttgcagacaatgttgagacaaagagttaggaagaaaaagggtagcacagccctgcaagctgcagcccgctcgagacgatagttgcccatctgtgagctgctgggcaagccctcctgaaacccgcagcctgagttggtcatcgaatccagtccatttgttatgggcctgattggaggtgagtgtaacaaacgtgttcagggacatcgtgcttctgccctgcaaaagctgcagcacgtgtctgttggtcctgtgggaaccttctgatcggcccagcttatcaaaagacaaggggaatttgagatttgcatcactaaaagccttctctagaagttggagttctggctagttctgaagaggactagacaatgctttgccattgaaacaccctaaatggagatgcatgtggagcgtaaagtgctaccagtgtgcagatgctgccgagtctctgaaactgcacaggctgcaattgtgggccacatcacaaggctggaggggcgagtgggcacagcacgggccaggacttgtggaagcagggaaggtgttggcccctgggggaacagccagtgaaatgaagtcccggcagtggagagggaagtctggggctcaggctctggacactttaggtaggagtggctctgccttggctggggccagtggcaggttaacaactgtgtgaccagaaagagttagagctaaggccatgacctcaaatgcacaggcaaggcaggcctggtaaggcaaaggctgaagaggcagcatcccagctcttgcaggggagcccagcctgcagccacgtgctggggcagatccagacgaccgaggccctgagggcccagcctcatgccagcaagttttctggcagacacccccctcccctgcccttccccagtggaacctctttccactgtcatctgccccccaggcctaacatccattccacatccctgttctgagcctctcctggggagtctggctctggaaagccccgaatctactcacttatgtatttccataccccaccaggctgaggaagccactttcccatcttgcctctgtggcaggtgtagttagtccggcccctccttacgccctggggtgaggttgggcctgcgagtcatcccgggccttgggcttgtcataggcggcttaagagtgactttgggtaattctagcccagtgagctgcttctcacctgattgtgaccccagcaggggcttccctgcgaccatctagctctttgttgattctgattgaaccaggttaaaggcctgctagacaggcagccatccaaaaatgcccaagaggctgacagtaaatgttttaagtgttgaacaatttaatgaattgcatttgcctgtcatctgagcaaatgtttttggtttggtgaggagacttgcattttctgcttttatcctagaatgtatcagaacatttcagggttttttagatccctaggaggccagggacgtagagtctggcaaggattttgacggcagaaatgaagcttagcagtactgtcctgtcttcctgccttccatgtgtgttctcacacaggaagcttcccatcccatgggcctccacccactctcaggggcggaggcattgaaaacagctgaaaacagtggaaaagtgcagaatacatctttgcactgttctcttttccctcattatttcaggttttattaaccacacctgtggtgtgacgctgctgggaggcactgggtggctctggtgtaccttgagaaatttccatctccaaagacttccttacctcattacttttaaaatgaagggaagacagcatgttggtaacctggccctgggcctgttgggaatacctgtgggaatctaatgggacggcctgtcatgggacatgaagattttcctaagagctggggctggagctaagcccacacatactttgcttggttctgtgtgtggccaggaactccacttacatgagatgctcttgggggtgggaatacagcctctaatgatggaagattctctttctctcaatctctctctccatgtaacaaaaatgcaggtgcagtcactcactgcttgcagactccagtgaacaaaagggaggcctggtataaagaaactgactttttattccaaagctagtttaggggaagaagctgccttgaagggtactgtgtcgtttttggagcagaaagtgggcacttttaaaggggcgggggggggggtgctggcacgaatggcatgcaggagaggaagcgggcaggtgggggagtccacatacttgctttgatgacttatgtaacgggtggtcaagttggcatcttcgtgggcagaactaggttgtaaagtggctgaagctctccgggtgggagggagtttcatagtgggcatattttgggttattaattgactgttgtgtctccaggcagtttcctggtgggtgcaagttctgctctagagcttctaagcacacagttagatgagcctgccctggagggagtgtctggtaaaggggaggtaaaaggttatagttgcatttcttttatatatatgtttatttgtttatttatttattatactttaagttctagggtacatgtgcacaacgtgcaggtttgttacatatgtatacatgtgccatgttggtgtgctgcacccttaactcgtcatttacattaggtatatctcctaatgctatccctcccccctcccccaccccacaacaggccccggtgtgtgatgttccccttcctgcgtccaagtgttctcattgctcaattcccacctatgagtgagaacatgcggtgtttggttttttgtccttgcgatagtttgctgagaatgatggtttcccgcttcatccatgtccctacaaaggacatgaactcatcattttgtatggctgcataatattccatggtgtatatgtgccacattttcttaatccagtctatcattgttggacatttgggttggttccaagtctttgctattgtgagtagtgccgtatagttgcatttctaaagggctaagtaggaagtggggaacaaggggaaatggggaaaagagaagagaaataattttaaaaactcgttttcttagaaaaatgagtgtactcagttcagagtgagactcatagacagaagacttgtctgagagctgtaactgccaggattcccttttacatcaaggagaatttttttgagattttaggaaacttttcctataggtcccattgtggcaggccaggtatcactaatgcaggcatccataacaactgtttcaatactgactgagtggttaagttaaacattaaaagctgagagagctggtggccttatacaaaggctggaatgtaacaaaagcccaccaagagtttgcctaggcctttgctgggccttgaagcatgatgagataatgaaggaattcttagtgggacctgtttaggattaaacaagctttactgggtgtctgaagaaactccccaggcctccaaaaacaagtttattggaggtctgaaggaactccccaaaccttcaggatttagcaggagacaagataagggtaatcaccccagcacctggacccatttagattaagtaaatctattgaggctccagaggaaggtcttcaggacttagatgttagctacagattaaaagaaattaatcgcttatgtctttagatgagtgcacacttacacatagacatgtagcttagaagatatgcaagctctggaaaactttgtaatttgagttggtctggcgatattttccaggccttctccctgtaaccggttatggaaataaaaaactctcttcctccccagttcatctgcatcttgttactgggccacgagaaatagcagcccaaccctcagtttggtccaggaacaaaatctctcatcttgttttctcctccctttattatctcctacctgctgagataataaacgtttctaccctctcactgtgcttcggaatcatctggcaagacttaaaaaatactgaggtctacccccaccccacagggattttgattcacttggtctgaggtgaagcctaggcagctgtatttttttttcttttaactccaggtgattctaatggctgggtgaattcaaaaaccacaataaaatatcagataaaaaaggaaactggccatggcttaggccctgtgggctcctggcctgccagctccccttacctcacagccctagagtattctggggttgacggtagaaactgagtccaggctctggagtcaggcctgtggcctgctggcgtgtggcttgggacccatctatcaacctctctgatctttccatatcaatctagtgtgtggatgacatcaatgcccacctacacctggctgtggtgacgatgactgagaacattctcataaagcatttagcataaggccacgaaaacagggagctgttctgcttggggcctgccatttctccagctgtcttaccctttctccagacgccctcagaaccatccctccccccagagaagaaaacccagaagctcttctctccttgtggctgttccttcccctccactcttctgactcttgagactggagaggggatgatttgcaggggagcagagtgctttcttgcctaaagcattttcctcttattataacttggttctgccattaggaaaagaaagggggaaatgaccataagtctcctgctctccttgtgatggagggaggaagatgggggcccagaaagggaagccgagaggaagagccaacctcctcattaaattctgcagtgttccaggtctgccattcttcttgacatcttataaggaagatattatttcttccatttcctgatgaggaaactgggcctcagcgatgcttaatgaataaccgcagccagtgcacaggaatcacctgggaatcttggtaaagttcagattctgcttcagcaggtctgggtggggcctgagagtctgtagtgttcaattcccaggtgaggtcaatcctgtgagtctggcagggaccacactttgaggcgtcaggtcctaagacagcaagaaagtggctgaaacttgggtgtgtgtccaggcctgtttgactccaaagcccctgactttctgttccaggatgttttatggctccaagacatttacctccccttgggtcagtttgagccctttgaaataagccacggaaaccccatggatttctggagttagtctggtcccagagttttgctcccaaaagcttcagggcagagagggtctgcttggtcagctctgatcattaggacatgctgtgaacacttggcctctggtggggacgggatttgtggacacaaatgaaggctacatgagcaaagtgtagcctattcagagcttgctatagcaagggagcctgccatgacgacctgagttttggcagagactcatatgcaagcagaggtaatgctgcagcttcatagtggaaaaaggggagacttcaggtatgccctgattggaagctgttggcctggggacgctgtaggcacgaagtgtggactgtggcttgcttgttacagtatcacccacggtgcttgttaaagtacagatccctgggttgtactgcagacctaccgaatcagagccttgatcactcaaagttgagaacctctgtcacaatctcaaagctttcagtggttattaggttcccaggctagcccacacctgggagtcagcatccctaaatcagtctttaccaaatgtggttgatgaaaagaattgcttgcgggaggagaacggggagagagagacgggaacaagtgctttttaaaaactcagactcttagtctcagctgtagatctgttactggggggaaggcctgggaatctgcaaattatcaagcagctgattctgaggatcaggaagcctgggaagcagcgtcctaactgcctgctcccagccgggttccagacagcacggcagcatcactgtgtgcacagatgctccctggtgggtgtttctgagtcagggacctcttgggggctcaggtttggtccttatgattactggggtttattcagggggcgtgctggtttcgccatattccgtcccctggtgtttcagtgaagctggctgtaacatttgaaggctttgctttattttaatcacatctttataattacctcgctgtgagttgacagctgttattaacatcaccttgggttctccttgagaatttttacatccttaaagtgatgcggcacttctgcagctgaagtcagaagccgttaactaaataatcgctctaaaatgtcaccaggttttgtaaacatagccaatactgtccccttccaaaggaggaaaaaaaattgctagataaataattttcatgaaggcaatttgtttcccagggtctatattattttctgtctcatccactggtttttgccgctgtggggcactggcaataaagagctgtctcaagaaggaggccacgtctgctcctgccaattttcatctggaagcccacttcagggttcatggcaatgagaagcaaagatttttggaaaagacttttctttttctcttaatgctagcagcagttgtgtgtgtgtgtgtgtgtgtgtgtgtgtgtgtgtgtgtgtgtgtgtggaaaatgatgggagtggttgaggttcatagagggaattattttaaaaactcttggaaacattgttttgagttttcatccaagctagtttgaggaatggctagaatttcagctgaactttgattagatatgaaaagtaatgtcctgggctaggtgtggcagctcacacccgtaaacccagcactttgggaggctgaggtgggaggattgcttgagtctaggagtttgagaccagtctgggcaacagagcaagaccccatctctacaaaaaaataaaaaatcgtagctgggaatggtggtgcatgcctgcagtgccagttaatcaggagactgaggtgggaggatcacttgagcttaggagttcgaggctgcactgagctacagtgagctatgattgtgtcacttcactccagcctgggcgacattgagtgagaccctgtatctttaaaaagaaaaataatttcctatttgtaaatgttggagaaaatggagaatttcttccatagaaaggtatgctgtctccttccagtactgcctctatggaataatctagatcttgctttcagcaggtatcaggaggaaggctggccagggtaagaggcctgctctgccctcactggcaatgtatctttggagtgagatctttttttcatgtgtaaaaggtattgaaaaaacacttgctttgtccatctcatagcgtcttttttcctctaaagatttaatgaaacaatgtacatgattgcattttgaaaaagtagagtgttacatacaaagaaaggtagaattattaactggagcctcatcccacactgtgtgcaaagcctgctgtttagcagtgttcagagtaattgccagtcatctatctgactgactgacaagcctcatgactcaacatgggaaagatgagagattcagaggcttaatttgtttttttccatgtggtatatttgacatatgtacttgcaattgcaagcaaatattgtaaagtcttttctcttcactttgaaagacatgaaaaccttcaaagaaggaagtcaattcttgctgagtttgacagctgtttttaagtttctccaaagatcaaagcgcagcccaggaatgagggggaaatgatattggcttcttttctcaatcgggatcttaaagtgcggaggcagcagagatgaacactaaagaccaaaatggccaggattatgagttccgttccccgaggtggctcaaaaagatgccttagaaaagacaggtttgcccctgttgtgcagatggcaggataaataggctgacattattatcactgctttgcagatgaagacacgggctcagagatgccaggtcacagagccaggggatggaggtgtcatgactcaggctctggtgttctaattccaactctcaggagcgtgataccctctggctcctgagaatgcgtggcccatttaccataccccttgtttctttcccctcctgctctcttcctcctctttttcttcttcctccaatttaggccagtcagctttatctatgggcattaactgagccccgccagtgctatcactccagccaaaaccgattgctgcctcgtgtgctagacttcaaggctgtctgcagtgacagcgttcagaagcgggtgactagatcagtggaatcctagagccacctgatgcagggcccaccgaccattcacaaagttactttgtgaagtccaggagtgcgatcaagcctgcagtgtccagggtccttcctaaaattgaattagagtgctgagtgaattaactgtttgctcctcttcttgtgtgatgcatttttaattacatttcataaaaacgtctggatggattgatggagctttagttaaacttcaggtaggcagggggagtagacgatggtgcagtataacatgttctgttaatacaggctcagaacacatgtactttatggcagttcaactgaatctttgatgtagggctacttaaaaatatattacctttgaaaagatttcctttgaaagatagagtgggtgctttagcagcctgtaagccgtcagccagacgatcaattgacaaacacgtcagcacttataattcactgcagcggctcccctgatacatgcaaaacactggtttatttcagaaaaagaatatatttctcaaaatccctttcattcacattgtaaggtttatgaggcaagtcttgtcaatcctaggcccttcacaatgaaagaaaagtctctttggtctgtctgccctgcgtttcctacaacatggattattttaggctctgaactgggcatacgatgtgaggaaggagaatagatacggcttaaagtaaacagcagctcagaccccagccacggagggaggttatatttcattttgaagattgtatttatacttgcaaaaagctatcactgttctgccagaatatgatgtttact

SEQ ID NO: 7069 - DNA, 1932 bp, Homo sapiens
  ENST00000465300
agtctgctcccacgctgacagccttctcctttgactgtgccagagaagcctgccctccgctgaaagaagaggaccagaaggagatcggcaccaagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaa

SEQ ID NO: 7070 - DNA, 658 bp, Homo sapiens
  ENST00000440012
caaggaagcagctgtgaacagcagaaagaggatgagaggattggggaagacctcggtttctttcctgttgcttcataaaatgtcagggctggacagcactggctacagacaggaatcagagggtccagagcttctaccagggcacctcaggaatcgtgcctgggacatggggacgctctgtccccattctaccagaggagcttctatgttgcctcattttttttttttgtatactgggcattcatgtgagatttcatttggaaagattttgctactgaaaaaaacttaaaaacagtcagcttggttcagagtttctgcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtcta

SEQ ID NO: 7071 - DNA, 616 bp, Homo sapiens
  ENST00000460951
gtttattttattaatctattttttaactgggtagggattgcttttgtaattagaaaaagtattaaaaactctctttaattaggaagattatgtaaagctgtaaagcaaatttattttgcatttcagaggctgtttctttatcttgctctctctcctgtggcagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagt

SEQ ID NO: 7072 - DNA, 7450 bp, Homo sapiens
  ENST00000475900
actccttttggctcatgctctgtgtgtattttttcaagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcaggtgagcacccccagccccaccccaccccatctcctggcagatttctgttctctcctggtctgtggttgaaccattcacccagttatcttagacctgaaataatcccccccaatcatttaaaattttgaaaatctgctttttttgtgtgtgacaatctccatattgccagaagacaatctttgtttttgatcaaaatgaagtaggtttgtacaaaagcaaaagtgtttttaaaaaactgttacaggttgaatctccctaatcagaaaattagaaatgctccaaaacctgaaactttttgagcgctgacatgacattaaaagaaaatgtacattggggcatttccgatttcagatttttggattagggatgcagaactggtatcatgaaaatattccaaaatcagaaaaaaagccgaagtacttctggtaccaaacattttagataagggacactcaacctgtgtgcgtttcttcctccttgcaaacaaggctgcttctagcctatagagtacctttgtgtgagtcagaaaaaagcctcctttttcagacagaccatgcctagtgggtgcatatggcttggtcagttgacagcaccatcaagagaattagaaaaagttgccatgtacaactttagcatgtgcagcctggcaagcaggcaccagctgggtttcaacccctcaggaccccttggccagtgctgggactgtattatgtggagacggggccttagcctgagtctactcagccttgctcaagcttcagctggtgaagggttgctccaatcctgtttctgctttgagtctgcaggagaagtccaagtgacttcattccagggctgaaatctgttcttgtggtccttgaggtggcaacacagaaaggacacaggctttggtgtccacacacccatctgccaccaccagccctgaccttgggcaggttacttatcttggtttcatgatcatttttgcttgcacaaagcctcctcccctgccttgggaaggtcccatctagggaggggggcagagggactctgttccctagactcccgatggtccccctgaaatgcagacagatcatgcaccagccctgctttaatctttgtgagactcctgagctgtcttcaggatagtgtccaggccccctggagtggcccacagctgtcactgctgctctaggatgtgccgccttcctcccaccccagctctatgctcattgaatcctcatgaccaccccacaggaggatgtagattccacttggtggagaaaaggagaatggagctcagaaaagtgaaatgcacaaggtctcttggtgaggagcccaggatgtgtcctgggagcctggctgaagggccaagaccccaaccctgtgctgtgctgcttccccctggcactctgcctcctgggtgcctgcatgcagtggccggtctctcaacttcttgctctgcccacttgtggctgccctgcccggaaagccttctccattcttcttcctctacctgggggatgcctgcttggctctggcattaccttctccctgtgtgcttctcaagactgcatcccacatggtatcactggtctgtctactgccctcccctcctagcccagctgtgagcatccagagaggggcctggcacatgctgcatggctgaggaccttggcaccagctgccctttcagcttctcccctgccccatctcttgcgcctggccttgcctctatgcaggttctgtccttccagcattcctggagtggcctcttaccttacgggaaggcaggtgcgagtgaggcagggctggctgcaggtgagctgggggagaacagggtatgtaagtaagatggtcctagacaccagacaaggaaccctttgccattgctcaaagtcagcattttctgcatgaaaggtttacctgtccttgtctgggtaatttacggggcccagaggtgggcaagtatcttcaccttatccacttactgtaattttttcttgtctatttccaagagacctcaaaagaagagcttctccataggtcttctgttaactctgtgtccaccaggaacacagaagaaaatttttattgacacaggcgaggcctaataatagcacagcttaataggagtaaatcttctgctaattacttcagctgcttctaagcttgagtttaatggggcttgctcccgcatgctggcccccagaagggcctcaccatctttgccagcttaagagtcaacacctgccagccaggcgactgccacatccttgcacctggggaatgtggctctgaagtagcctgagttctattagccaagacgtgatcagagaaggtggcctgggctgtggaattgagtttgggtggggactgctactcttcctgtggagtgagcttcctgggggctgaagtgtaaacacgcctcactctgtggaagagaattcaaggagcaagagtggataaaatgtagcaggatggggaaggaggctctgttggggggcaggtagagcccccccagcctttggtgggggtgggggtggagggtgcgtgcctgggtttggctcttgagatagttctcacttttccctgctgtattagcctgttctcatgctgctgataaagacatatccgagactgggtaatttataaagaaaaagaggtttaatggacgaacagttccatgttgctggggaggcctcacaatcatgccactcatcttacatggtggcaaggaagacagaatttgtgcaggaaaattcccccttataaccttttaaaaccatcagatctcatgagacttactatcacaagaagtacaccggaaagacctgcccccatgattcaattacttcctaccggctccctcccatgacacgtaggaattgtgggagctacaattcaagatgagatttgggtggggacacagccaaactatatcaccccccattaaaagaattgtgttaaaatacacaacataaaatgtaccaccttaaccatttttagttgtacagttcagtggtagtgtccatgatttttgcagtcatcttccgaactgttaccttgcaaaacagaaactacgtccccattaggcactagctccccattcctcccttccccagtccctggcaaccaccaactactttctgtctctacgattttggctattctaggtatgtcatataaatggaactgtacagtttgtctttttgtgtctggcttaattcacacagcagaatgtcctcaagatttatccatgttgtagcgggtgtcagaatttccttccttttttttttttttttttcagagagattctcgttctgtcacccaggctggagtgcagtgatgagatctcagctcactgcaacctctgtctcctagggtcaagccattctcatgcttcaggctcccaagtaactgggattacaggcgcccaccacaacacccagctaatttttttttttttttttttttttagacagagtcttgctttgttgcccaggctggggtgtagtggcgcgatctcagctcactgctacccctgcctccctggtcccggttcaagcaattctccttcctcagcctcccaagtagctgggattacagtcacgcaccactatgcccagctaatttttgtattttttttttttttttagtagagatggggtttctccatgttggccaggctggtcttgaactcctgacctcgtgatccacccgccttggcctcccaaagtgctgggattacaggcgtgagccactgcgcctggcccgatttttgtagttttagtagagacagggttttgccatgttggccaggctggtcttgaactcttgacctcaagtgatccacccacctgggacccccacagtgctgggattatagtcatgaaccacagcacctggccagaattcccttccttttgaaggctgaaaaacattccattaaatgtatataccacattttgtttatccattcctcaatggacactgggctgcttctgccttttggcgattgtgaaaaaggttggtataaacacgggcatagaaatctctgtgttctcacctatttttgcattccatagggattcaggatacttttgagttatcgttattcagtgtaggcggctactcagggtcattcgttttcttttggttccctctcactgtcccccttctagtttcccctcatctcccaccctggggctgacagggactgctttcttgtcacctgttctcttcctactcagcctgtttcaagcacaaggaatagaactctcaactctttccaaccagtgtacctctttgctccactttagaaagctcctccaagccctttaccccaggatcctttcctggggaatgctggggtgacccaaaaggtgcagtcctgcccttccagttatcaggaccaccttcacctctgaggatcctgtgaccctcggaggttccctgcaagagccccaagggtgcagcctcaaagccaacattccttgataaatgtcaccaagagagtgtcaggctgaccagagggtggcccagggcatcttccctggttcctccttattccaggctggctttgaaatcagagggacccgtggggctctaaggggaaggtatcctaggggattagatgatgtggtcctgatgaaggaaggacaaattgcagtttcatgaaaaataaaacaaggtggctcacctatgatcccagcactttgggaggtcaagatgggcagattgcttaagaccaggagttcaagaccagcctgggtaacataatgagacccccatctctacaaaaaaaatttttaaaaaaataactgagcgtggaggcgcatgcctgtggtcccagctactggggaggctgaggcaggagaattacttgagcctaggaggtcgagactgcagtgaaccgtgatcgtgccactctactccagcctgggtgacagagcaagacactgtctcaataaataaataaaacaaaaaataaagctccagatcacctctgaaatatggaatccctagaaatttggggacagcatgcggtagaaagagtgtggactttggagtccaggcagattaggcctttgtcctctgctttgccctttgccttgatttgagtcttgctttcctcctctggaaaacggacaagcatcctgcctctcaggggtgctgtgagcatgaaatggagctgtgatgtgaagctctgagccctgggctcaggcagtttccaggatatggaaactgttttccacagaattcccggcccacagaatcaataaagcgctgctgttagtgttgtttgcctgccccagcacttatccttcggctggatgacaggcagagcatgtgaatcgcaaagccagcttcgatagtgctaatgcgcttaggataatgcggccacagctgaaggcctgagcagcccctctggggacccaggagagcccttgatgtggttttaatgtggccacagccctggcatttactcaggtgatgaagagctggttggcagattcagctggcttctgggttttccggggtttagagagggttgggggccttgggaaaccagatatgggggcttatcactggaatggtctgtgcagagcttgctggttcacaagcacgttcatgcctctgctgctggtctcgtcctgaggtttggcatccgggcaccggggaggctgtgctaggcttctcccctgccagctgtcttgtctgccagcatgcttcatgtgagagggtcttgatttccctccccagtagtttttctctgtatttgtgtggacttccataggtggtgatgtggataaatgcagtattactatagttactatttgtcacctgcctgcctacaggtaggcactttatgtatattatcgaatttctaacaatctggagaggttggttcagcatttttatccttactttatgggtttggaaaaggctcagaaaggtcgggtggcttcctcatgctgacacagttgatgggggcaggattgtaaccaggcgtgcctgcctctttcctgttccctgggctggaggaaccattatgattgtcagagattctgcatatttctgcctttgcgtgcccctttctccataaaaaatatttaaaaattatagtttctgactggttggtataagcacagatataaaccaggttggacatattcatatattttctactaatgttaaaagaagctaacacattttcataggctgctaaatgtgtcatgatccttagttgctgtgcctgctgggctgccagccctttgggggacaaagttggtgtcccaagagagggaagtgggagagggagagagtgcctggctcaagtgactctccttttctgcctgacagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaa

SEQ ID NO: 7073 - DNA, 4403 bp, Homo sapiens
  ENST00000522781
aagtccccggagccgaggcttcctccgcgtgagcgcggcgagtctggccgcggatgccctgtccggagtgctccgtgccgccccaggcttgccagggtccgcagcgagacatgcccgagccaggcgctgcatcgacctcgacttatctgtaagcagcggaagatcctgaaggcactaactaaggtatctccaggcaaccaaggatcttacctctcacattgagaaaaaccataacttcagagacatttcctggctccaaattcaagtcctttcagagacccctctactaattattttccagtaccactctccatggaataaaaggagttgcaaacatggcctttgtagatgcagggaaacccacgttccttttagagctgatgttaacccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaagggctttcatatcggacggggcaagacacagctaattgtgacacatgcaggaacagtgcatgtattatctatagtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattaaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaacgctgatacaaaagcaaggtaaaacgcacagggttcccttatgtagatgtacacatggcattgcatatagagattaaattattatacttgtcgttaagttctttattaatttttaaataaaaaaatcaaagatg

SEQ ID NO: 7074 - DNA, 3149 bp, Homo sapiens
  ENST00000424811
ctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaaggtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaa

SEQ ID NO: 7075 - DNA, 4335 bp, Homo sapiens
  ENST00000614311
aagtccccggagccgaggcttcctccgcgtgagcgcggcgagtctggccgcggatgccctgtccggagtgctccgtgccgccccaggcttgccagggtccgcagcgagacatgcccgagccaggcgctgcatcgacctcgacttatctgtaagcagcggaagatcctgaaggcactaactaaggtatctccaggcaaccaaggatcttacctctcacattgagaaaaaccataacttcagagacatttcctggctccaaattcaagtcctttcagagacccctctactaattattttccagtaccactctccatggaataaaaggagttgcaaacatggcctttgtagatgcagggaaacccacgttccttttagagctgatgttaacccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaaggtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattaaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaacgctgatacaaaagcaaggtaaaacgcacagggttcccttatgtagatgtacacatggcattgcatatagagattaaattattatacttgtcgttaagttctttattaatttttaaataaaaaaatcaaagatgtttt

SEQ ID NO: 7076 - DNA, 4900 bp, Homo sapiens
  ENST00000585682
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagaagtagatttatttacacactgtcttatgaaattcttatgtttatgtcagcacagaacaagcacacatttagagcattcatctgaaaattatatggaaattgaacatgggtcaaataaagatg

SEQ ID NO: 7077 - DNA, 4985 bp, Homo sapiens
  ENST00000296530
ctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttttgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaa

SEQ ID NO: 7078 - DNA, 4544 bp, Homo sapiens
  ENST00000393807
gtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagcagcagcagcagcgtgtctttccatgcgcttggcattctttattttcccagcctgggaggatatgagagttccagggaaatgctgtattggacatgcaagactcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaagtcccaggaacatgtttattttagtcacctttgctttttaacaattttgttttgtaatcaatgagtaattcatgatgaattatttttgactaatggatagccgaaggccaggcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaa

SEQ ID NO: 7079 - DNA, 701 bp, Homo sapiens
  ENST00000590648
aattcacatgaacacccacatatcttttaaaacccgctttctcaccactgtgacagaattttatctcttcacttgttgagatttctctagagagtccagtactgcatcattttgacaaacctgaatgtggagagatgaatgcttctcatctctgaaacacttcaggatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaag

SEQ ID NO: 7080 - DNA, 548 bp, Homo sapiens
  ENST00000592586
tttaatatttgagagagtgagaagccagcaaagcctatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgttt

SEQ ID NO: 7081 - DNA, 574 bp, Homo sapiens
  ENST00000593260
ttttctccacccacggttcacatttggacagcagcagcagcagcgtgtctttccatgcgcttggcattctttattttcccagcctgggaggatatgagagttccagggaaatgctgtattggacatgcaagaatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaaga

SEQ ID NO: 7082 - DNA, 584 bp, Homo sapiens
  ENST00000589306
actataaatgtctttccttatctgtgtgtactcttatctcactgttctattttttctcctcatttatattaactctttcttacctttttttctgaacttctaggccttctctttccagaactggtggaagacaaatgaaacggccaagatggtaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcgggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgtta

SEQ ID NO: 7083 - DNA, 3425 bp, Homo sapiens
  ENST00000592057
actgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaaggtaacagattcacatgcttcgttatttgcagctgttggggattctggttcattttcttttttccctcactctctttttctaaatgatttttctccacccacggttcacatttggacagcagcagcagcagcgtgtctttccatgcgcttggcattctttattttcccagcctgggaggatatgagagttccagggaaatgctgtattggacatgcaagagtaagcccatactgtataatctttgctctccatttccctcgcttcacttcccagtggcttattaaatctaattaaagccaacggcaatttgcatgatgaggagaggaagctaggctggaggcaaagaacttgctgacagtcaggcatactattaaataggttactatgggaggaagtagaagtttttaaaagtaagggggaagcgggttatcgttcttgagcagatggaatcttcttaagccgcgcagagccagaccatgttaggtttaaccccccctttttttttcaatggatttaacctctttatttaacaaataaaaagaatgagcaaaaattggtgatttgttcagtatgtatactaactagctgtgtggttttatcaagcccctgactatgatctattgagtctgtctttcaagattctcccgtcttgggtgacaaacattttggcaggttctaacacatgtagccagttactgcagttgccagcaaaaggactggtctgcggtcatgcccatgccatataaaggatattctctgaatattaaagctattccagggctcgaatacaaagtacagtgagtcagtggcttatgtttgaatgcagaatgatgccagaagttacaactttgaatccagattggcccaagaggctaaaatgtaccccaaagagattataagctgaaaggatacttaactttctccatgttaccatgaaatttagcatttcagtgaggttcccagggagcctagaatggaatggattaaaatccctgggagtggctgagacccaactgcatttccaatggctttagcattataatttcattttaaaatggatacccctggaagtaccagtgatttacttagaaaaattggacattccctactgatggtggttcttgtctaagtgctccagattcacaggtatgctttgatgtctcaagtttataaagcagtccaccacagttatgccaatgtaagaaaccttctcaaacatttaatctaatgttgataaaaatgaatttttattgggtgcccacaatttgctaaggattatacaaattgattcatatgtgttggctcctagaattttcataacaatgctatgaagtggggactattattatttccatttagtagatgagaaaattgaggcttattgagacaaagtaattggcctcaactcccacagctagtaggtggctaagctgggttttgactatagacccagcaaacttcagaacataacttcttagccactggacttaggtgaatatgtaacttattatccaaactggaaccgtgtggcgtgaaaggagatgctggtgggcattgggacaacaggcccacactgactgttctgagcagagtagagcacaggatcccccttgttatgctgaaatcccattcattttcatgtcataaaggccccagagaggagaagatgaactcctgtgtatatcctgaggcagagttctctgatatgtcctttgagcttcccttagacgctcttagactactgtattgggagaatgcagtagtggctaagagcctgggccgtggagttggactgactaggtttgaacttaccaatcatacgacttggaaatgttgccatgtctctttatgcctcagtttcctcagctgtaaaatgacaatactgcctaccatatgagattgttgttagttaatacagggaaaacacttagaaccagtatttgccacaagataaaccttcaataaatattggttattattattattattgtaccaagcacatgaggtaccaagttcattgaattcctcacataatctccaagtctcatgtgttacttcgttacgtgataggactatgactaaaactgctcaattaaacttttgtaatcccaa

SEQ ID NO: 7084 - DNA, 587 bp, Homo sapiens
  ENST00000587787
attgtaaaatatagtatttttaggattatacaccatatgctaatcttttacccactcttcagtatcacaactttctttctctgtggggaggaaaaatccctgtcccctttctgtcttcttgccttttgattctatttgccatagtctaattgacaccccaaggtcatcagcccctgcctttgtgctaggacacgcaaaccacccaggccaatccctaacctgttttttcaaaaaacctccaatcagagagaatccacgacttccttttgtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatgaccacttatatcccgaagcggacgcggcagctgaagtcaggaaaccatgcatcacattagcaggagccaactgcagactttaaactccgttcaacatgtggatgcggcagagaaatgacctgtccagacaagccggggcag

SEQ ID NO: 7085 - DNA, 2014 bp, Homo sapiens
  ENST00000478136
gatactttagagcggagggatgtattgaaacagactactgctacttacagcaccgtatagcagccctgctcctacattttgctgccttactctgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacatttttttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaccta

SEQ ID NO: 7086 - DNA, 1917 bp, Homo sapiens
  ENST00000496687
agacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaa

SEQ ID NO: 7087 - DNA, 648 bp, Homo sapiens
  ENST00000491017
caggatttaagacactttgaaaatgggcaaagcctcatttttcctaggtcaaaaggagttcaagattggggaaatctgaggattcagaaggatgataaatatgtcaccagcactaacacctgtcctagttccagctctggtgaactccagcagacctgctcaagtggacagcattagggaccttgtcagttttgcagtgctttttgcctgaagccacctcaggtccctcatgctgcagttccttttggccgcaatctgaatgcagtcctgtatgggataaaggaatatcataagtatatattttttaaaacagcaacacgattcatgactctgttgcagaatgtgaaggagcaagtctctcaattggctaattgaatcaagctctgcaatttccttcttccctggagcctgatcctgcaggacaaggatctattttcaagtcaattacaattcctaagggatataattacctacaaaatcagcaaaggaaccctatttctcttatgaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgg

SEQ ID NO: 7088 - DNA, 159 bp, Homo sapiens
  ENST00000617084
ccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatggtgctattatttga

SEQ ID NO: 7089 - DNA, 2292 bp, Homo sapiens
  ENST00000295569
aatcagcgcgttccgcggcgggcccggcccctcctggtcagcgcgctagctgggctcggctccgcactgctagctgcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtgagcgtcctcgggctccggtgcggcgatcagtacctagttccggacgcgccggtccgacttggatgccggctctagtcgagtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttgcttcccgggacaggtggcgggcacaactcgggctcaaccttcttgtgttgaagcttccattgtgattcagaaatggtggtgtcacatgaatccgtgtttggaaggagaggattgtaaagtgctgccagattactcaggttggtcctgtagcagtggcaataaagtcaaaactacgaaggtaacgcggtagcgaagagagaggtgtgcttcaatcctggaggggcagcaggaggcggagctcttttgcttggattcccatcatggcccctttgcagaaaattgtctaggatttcagcaacttcatatttgtatatgtgagctgtgagaggtggcattcacttaactggcccagccctctctgcttcgtgattttatttcattgaattataaccacaagccaccacccatttgacatcctctctggattcccaaggagcatacctccaaaatccgagaagagcaaatcagagtcttcaaaatggatcaccactaagggcatgttcattcttcactttctttctgcttttacaaaagaacttggatgtatgttccaaagggtcctcattctgttcctcttttgaacttttccttttgtccttgtattaaagtggttttaaaggggtctaaaaagattttggcaaaacatatttgcagatgtagattagctggtgaagaaaattactgctagagatcaactgattaactggtaaagaacgtttattttataacccttgaagaatagaaggacatagttggattattgtgtgtgcattgtatttttacttctattttttttttgctttccattttccagttagcagagataaaatgagagcgttttaacttcaatgtaccattttactgagtgctaaggaagcatatcaattccaatattttataaccaaagctctatcagaacatatttataaaacttgttggaatttttacggcttttgtgtagtcatgtaggtaaatcatttaaaatataaaacaatctcaatttagatcaagggttatttcttagatcaaatttatgccaattatatgaaaagattttaactccgagacaggagtctttcagtgctgaatttttagactgtaaatgagttcttcttaacttagctgtttccctacttctgtgacttctgtgttagccatcttatttctttaaaatctgagtcctgattggcttaatgattttgcagcagacatgtctccacatattctcaaatgctgtcatgcggaaacgtatgaaacagatgaagaatgactgacccagattttagatgtataatgttgttaaagtacatactactgtaaaaatatgggatgaattttatatattaagaaatgccaaaaacatagtttctgcaccaagttaattatccctgtcctttcacatttatagggggaaaataaatactttaatgttgtttatagcctaacagttatttgattttattcttgcagagggaatggaaaggaatggaaagatttgttggcgtaatttttgaatatttgttatgatcatatgaataagtaaaaaaattcatcctgctgatggca

SEQ ID NO: 7090 - DNA, 602 bp, Homo sapiens
  ENST00000495737
gcgctagctgggctcggctccgcactgctagctgcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttg

SEQ ID NO: 7091 - DNA, 1300 bp, Homo sapiens
  ENST00000634242
gggggcagtgaatgaatttggcatttatttccttaaacttgtaaggaaagtgaaagtgtaaagataagaaatatgactttaaaataaaaaagtctttggttgtaatcattcgtcatgcctctgatacagatttccagtcttagatataaatatttcaggatcgagacgctttcatctttctctgccttgcaagaagggaagattggaaacaatcttccttaaagtaagcagctttaatcattgtttctaaatcaactgaactgtgtagggaaaaaaagaagatgtaagaatcctataatccctggtttagttgtaatgaaaatgtccaggctgagaagggaacagatggattttgattaatttctactaagaccagcaagtatcaacctcaatattctttataaacttgtcagggtaaatgttatgtagtcataagagaatgaagaaaaaaagatttataactgggttatgaagagttaaagaggatatacttaaaaacacgatccttagcaacatgtcaaaaatgcagattcattgaatcacggcaatttttttcagagactgtttcagatttgttcctttaaaacgaagttgatatttttaagaagaggacttgtacccattgccttgggtatccagtgcagtgggccacaacatacccactacataggcttaacggtatagagtgatatatttacatagaggaaatggagaattattaatgaactatgtgatcgttgtgcctcccatcactggaatgtggaaacgtatatttactgcctgaaatgacttcacttgctgagctctgaaccacagtatttcataaatgattaacattagatggagtcagtgggaacctcacaacatttcttaaacagcattccacaagaaagaatttctcacaattgtaaggacttgcatgctggagagaaggcaagcaaggaacaaacagcactgtaaattgaataccagcagctcacgacttgaactgccattggaacccaggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgt

SEQ ID NO: 7092 - DNA, 3668 bp, Homo sapiens
  ENST00000226094
actggggactacatttcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggaccccaggacttcttctccccctcaggtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacgaaggaaaaaaaaaggaaagtcctccaaggtcaggatggcatgggaacaggcctagcagggacacaagcctggagtaaggcaggaaaagagccaaggctgactacagcccaccaaccacaatcttcttccctaagaccccaggattgtccccggcccatccccaaaagaagaaaggggctatgtggaaaggtgaggccctctagatgcccctccctgtgacggctggctcaaaaaagactaagtcaggttttttattgaagcctcccttagaagaaagtgtagtagggattccttgtctcctctaccttctccctgacttgttgatatctgaaactccttttaataggaggctttgtttcttattccataattaatgaccgaaaacacaaaggacagtaaggtcttcattccatggagtgactagtcagtcaacaaaagtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatacaaaaaaaaaaaaatttttttttaaatcaactctttaacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctgagaa

SEQ ID NO: 7093 - DNA, 2955 bp, Homo sapiens
  ENST00000592554
gcagcgccggcttcggatcgggagttggccgtcagctgcgccagaggcaggtgccagcggagagtgggtgggggtgccggcgccaggccaggctcggggaggccccgcgctacctctgcctctaggagtccaggcgcacagacaagctccccggagccgctcctgcttcgccaactccccactcgcgccgcccgtgccagccgccggcactggcgtctccgccgcccgcaggaggagtcgcgggagcactagcagccgccgccgagcgacagcatcctcaggagagacgccccgggctttgcagccggcggcctccgtccgccctccgcggtcgccccccgccccgtcgcccgtccgcccgcggtggcagccggcgccggcgccccggggcccttcacctgccgcgagcgtccgggcgggcgggcgcacgggagaaaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaa

SEQ ID NO: 7094 - DNA, 804 bp, Homo sapiens
  ENST00000590873
cagagacacaatgctgagatcgcagctttccatctggacagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggata

SEQ ID NO: 7095 - DNA, 2081 bp, Homo sapiens
  ENST00000375556
aagaggagtgagttggtccccaggccacacagcccagtccttgacagtagccacagaccctgtaccagggacttgttgctagcttggcttttgaatctgaaaagctgcctcaatactcctttgccccatttcatattgatcctgggatcagcaggcctgggtctgttctcccctttagttcatttattcagttctaaagaaccttccatatacccaacactaggtgttatgggatacagaaatggaagactcagactctctccttgagaagctccttggtctagtggggagaacagacatgtagccagatcacgaaaacacagcacagcacttgctataaccagggagcacacgagaatcccatgggagggacacctggttcccgagcaagccctgggagaccaaggacctcactgctgtatccccaggacctagcaccctccctggcacatagcaggtactccacactagctgactgagtgaatcgatccatcagtcaagccgtcatgatcatcgtgggaaaagaagtaaccaggcagaatttctggaggacatgacagatcctaagggactctgtgaaggctgagaagagccctcggatgaaaatgggcatcggagcattgtaggcagaaaaccatgtgtgagagagaaagggcaggaacagcccatggaggtgctatgagtggcgcagggtccaagaggcttggtgagagggactgtggagggacgaggaagcaggtgagggtcactacctcctcctttcctgcctgccccggcctctcccctctggcacacagtatcccaaccatgggtttagtgtccaccagacttaaaggacccaggaccttctcaccacacggaatatgcagccttacgcgtccttgcccagggcctttctgaattttagaagctgccaccagcccagggcaggatcagggaggcagggattgggggggcagggggaggtgtggggagacccccgacaccctgccatcttggcttttccagccccaggacttcttctccccctcaggtgggaggtcaatcccctttactgtgacacagtgaaacagatctacccgtacaacaacagccagcggctcctcaatgtcatcgacatggccatcttcgacttcttgatagcctcagaagtggcggaggtcccagaggacagaaggtaacaggctcccctctcttcaaagaactggaagaagctcaaggggtcgtcactcataaggcaggcatctcaccctgccacgggcctgagtgggcgtcagattggaagctgtatgttcacttcaccaagtgaggggaaaccagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtgga

SEQ ID NO: 7096 - DNA, 1642 bp, Homo sapiens
  ENST00000590074
acttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcctcagttcctgcttttgaaaggaagagggggagtctgtgacccctgaggcctccttgcaactctgttttccaagctttgcacatcttccgaatttcttcttcaaagtctaccctaatgaaatatcagacaattttccaagtgtgcttcatgaacttctgggaggtgcttcacagtttctgcaaatgattgattgaattttcactttgaaaaaatatactttaaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctcc

SEQ ID NO: 7097 - DNA, 824 bp, Homo sapiens
  ENST00000592847
tcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggaccccaggacttcttctccccctcaggtgggaggtcaatcccctttactgtgacacagtgaaacagatctaccc

SEQ ID NO: 7098 - DNA, 2798 bp, Homo sapiens
  ENST00000619787
atgttcacttcaccaagtgaggggaaaccagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagttggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacgaaggaaaaaaaaaggaaagtcctccaaggtcaggatggcatgggaacaggcctagcagggacacaagcctggagtaaggcaggaaaagagccaaggctgactacagcccaccaaccacaatcttcttccctaagaccccaggattgtccccggcccatccccaaaagaagaaaggggctatgtggaaaggtgaggccctctagatgcccctccctgtgacggctggctcaaaaaagactaagtcaggttttttattgaagcctcccttagaagaaagtgtagtagggattccttgtctcctctaccttctccctgacttgttgatatctgaaactccttttaataggaggctttgtttcttattccataattaatgaccgaaaacacaaaggacagtaaggtcttcattccatggagtgactagtcagtcaacaaaagtaaaaatgcctcatttcatcaaatcaacttttccagtaaaggccagagttcaaatactgtaagcatgagaatagaatggagctgtcactaaagagagtacaaggtcaagaaccagaaatgtctccaagctttctgcagtgtgagcaaagatagcctcgactggacaaataacacttctgaccccgtggtacccccacatgactggtatgctgcccctggactttgtgtctctctaaaatcactaccattcactgagatctgaccaggtgaggcactcaccaacgctacagaagcaacacacaggtttccaatcctctcaaacacagatacaacccccatcctccaatgtgcatggaagaactttaaatctcagagagagtaagcaaaatcacacaatttagtggtttagacctattccaaagtcttcttttcactgtaacacaaaacccaacagtatcccacccaatttatgaagtcaaatttgtttgcttaaaaaaaaaatcagctgggcatgggctcacacctgtaatcccagcactttgggcctaaacaggcagatcgcttggtctcaggagctcgagaccagcctgggtaacatgacaaaaccctgtctctacaaaaaaatacaaaaaaaaaaaaatttttttttaaatcaactctttaacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctg

SEQ ID NO: 7099 - DNA, 501 bp, Homo sapiens
  ENST00000527570
ggggaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgggtctcactctgttgctcaggctggagtgcagtggcacaatcacaactcactgcagtctccacctcccttgctcaagtcatccttccgcctcagcctcctgagtagctgggactacagacatgcaccaccacaactgggtctgctggagtttgctggaggtccactccagaccctgtttgcctgggtgtcaccagcagaggctgtagaacagcaaagattgctacctgctccttcctctggaagcttcatcccagaggagcacctgccaaatgccagctgaac

SEQ ID NO: 7100 - DNA, 5980 bp, Homo sapiens
  ENST00000357260
gaccgcgcgcggctagccgctggggaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaaccttctgtcagcttctttggcaagacattgctccaggcacagggactgaaccccaggcctcctgggactggagcagcagtgaggcaaaacccgacctgctagccctttctgccttggaggtttcagtccatacctggactctgagaaaatgagctgaataaggagtacagtgtgtaaggagcagccagggaagccctagacactccccgcgtctcccccatgcacaggggaaggatgttgacatagcactgggctgtttgaatgccttttcatctccatggtctcatttgaaagtgagcgaggcaggcaggcatgatcccattttccagataaggaaacaagcctagatatgctacatgtccaggaacaactgcagccaggaggcagaacagcctaggtctaactgcagagtagaagctggaccctggagttaccaacactcctccccaacagttcttagcaccccgcaggctgggcgctgtggctcacgcctgtaatcccagcactttgggagggcaaggcaggcggattacctggggtcaggagttcatgaccagcctggccaacatggtgaaaccccgtctctactaaaaaaatacgtaaaaattagccaggcgtggtggcacacgcctgtaaacccagctacttgggaggctgaggcaggagaattgcttgagcccgggagagggaggttgcagtgaggcgagatcatgccactgcactccagcctggctgacagagcaagactcccctgtctcaaaaaaaataaaaaaaaacagttcgtagggccccataccccacaacccctgtctcctgcacttaactcccacctgggtcagagaacagccaattcaccagtgaggtagaagtgaacccagaagaaatagccacttgattttaaaattcccagctccattccgtggccttctccccactagacacagcagtcccaggcctcctgttccctcctcacctagaggcagccgggacggagggggaagggccaggcagcagctcagctccggcttctctaaagccactctgggcacgtggcccaggagggccacctagtgatccaggcccccccccaggactgccctgggaagccactgtccctcccactccagtagggaacactcactggctgggaaaagacaatgtggatcttcttttgggctgaccaagccaggagggcacaccctcccactgcccctctctgcctcccactgattgtccctcagcctgatggggtgtgacagctgcaattagaggcaggattccttcccaccctcaaagcattaatagccagttggagaggcaaaatagtaagaaaaggctcttctgcttgcttcctggatccctggggagagtggagagaggggcagagctcaagatgggattatgggggcgcagccgcggtggttagggtcactctcaaatcctacccagtcaaatggtaagatgtttcatttttggtgggggagctgcaggagggaggaaggcgctcatgctttttgggttttgttgagcactcactgtctgtcaggtaatgtgcacatctctcaaacttagaaggaccctagaaggcattgttctccagacacatctatggaggttattagggggcgtgtaaactgccccgattaggctgctagcaaaggaaaggacagagatttgaacagagggttgggttatctggctccaaaacccctgtccttttcttgctatttctctacctggagtttgccaactgagcaagcccactctggtggagccagccactgcaaatcctttgtgtcttcccagagaataccaacatttcagttttgagtgagggaacgttggctctgactgcctttggaggtggagatggtggaggtggtggtggtggtggtggtagtggtggtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacaggctcagagaagttaagcaacttgtccaaggtcacacagtagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatgctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctctgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctcccttcctcctgccctccggccaccctggaaactaatggcctaaaggtgctgtggctgtcctcctaaaatccattccctcctgatggggtggaggaatctgtgaagcccaccttcaggagaggtctcggggctcgggctggtgctgccagagaaagggtgactgaaccagaaaggcctaggggaaagcagctcaaactgcagccatccccttagtacgattactaggatgtcccttgccttccttttgcctcctccacccaacccctaaaataaacagtatgatgaaacctc

SEQ ID NO: 7101 - DNA, 1217 bp, Homo sapiens
  ENST00000534365
agctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttgagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctccctt

SEQ ID NO: 7102 - DNA, 1423 bp, Homo sapiens
  ENST00000444059
aacacgcccggcctggaagtggaagaaagggacgggagtcggaggctgagagactgcccagacacacaaaaaatgtggcctgaggaaagccccaagagggaggagaggaaagatgaggcaactgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaa

SEQ ID NO: 7103 - DNA, 556 bp, Homo sapiens
  ENST00000527621
caaatgggcgcatgacgatggagagcagggaaatggactgctatctccgtcgcctcaaacaggagctggccccatgctttctctctcccctgcagatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgcc

SEQ ID NO: 7104 - DNA, 2785 bp, Homo sapiens
  ENST00000412270
gtctcgcttcgcggccacctcttccccaacgctacccgctccgtaccctgactcgctgctcctctgtgctggcagagagcgcgcagaacgtagctggacccaagggtttatttaccacattggctggtgtgtccatctgctgtgcaaccacatttatctccggtgagataaaccccatttatctcctagcaagtccctggcgcacagtgagctctgataaaaagcagcccatctacctcctccaaccagacccaactagcccagatgcttaattctccatgacttgtaacacctcaatacctttgtatttgctgttccatctacctggagagcctttccagggagctagaggagggagagattcctatgaactgaaaagggaggatactgggatgaggatgcttgtaatgtggtgcacactgattaccagagcacagctgagatactgttgggtcctgtctcctcccaaagcacacatcacatcccagggtgcacaccagtaaatgatcagattctggacatggggagccaaggacaggggaaggcagagagaggagcagaattgcaaccactgtcgtcatgaaggaagctaggtgagagagctggcacaaggtggcaacatttgcatgaagaggacaaacaactggaaataccaccagggggcgtgtgtagctgtaacacaccagtcatgctctttccctacagttaccaggcggggtttggtcactatgcataacctgagaaagatagacaaacagcagacagatagataggttgggggtgcttagatagacaaatatcaccagcctcctaagctcatcctggtgttgtgattggccacaccaaaacgtaacatctccagtctatctgatatcattgaacaggtctcctctaaggcaaggagttggattcccctagaacacctgccaaagtgcagtggaagggaaggaggtcttgcctgggggcagtggtcactgggcctgggtttctgtgctgattctgcccttagcaacctgggtgacctagggcaggtcacttaacatttctgcgctacacttttctgacttgtaaaatcacatgcttgggtggcagatgcagactgttagtaatttttaaactttagagatcacggaggagaaaactgagatccaaagaagttaaattacttgtccaaagccacttgatgtgggagtggaatgaccgagaggatgtggattctggaaccagagccagttccacatgatggttccagcacacccctcacactgccctctggtgatctactgtctcctcatctcttcctcctctgcagaatggaggaatagcagcacctacctcccaaggttttggaagaataaatgagtacctgacacaaggaaagcctccaatatatgttagactaggcctatttttagtgatgaaccagaggctcatacccacaaatcttttcttccagtctttctgtgaggccacatgccctgatgaaggtccttttcagctcccaaattctatgattctaagtcagaaagattaagatgcaagttatttccaaaaccctccaggcagaaacacaaaagactatttgagagattcattattcactctctattgcctcagtcactttctatggatgatgattcatggagaataatcaacagcagagaagatctgttcaatgctaggagagaaggcagtaaagccgaaactccttcgcgtgttcagttcctattctccagtatgcatcttcacttgttaagcggcggcagcatttcttggcctcgctgcctttcttctctgggaatttgaggtcttctcttggtatagactgttgctagtgcagtcactgcccacccggcaccactcctcaaaatgccagggagaaggtcctgcctctctggccaagcaaaagcccgcacagaagcagctgtcaccagtggcactggctcttctcagggtgtccaggctgaaatgtttagcatgcccaaggttgatgtctaatcacagctacgagaattctctggctcctgaaaaacaacagaagagacttaagagccagtctggtggaagcaaacatgcagacagccaaacctgagatgtgacctctttttctcctcaccccatggtctcaggaggagaagcaggtggcttttctttccctcttgctaatatgtctctccctggcaagctgccaaccactggtccttgcttacagctagctagtggagatggccaagtggtatgtgataaaatgagcctttgctctgagttccaggccatggtaaggttacagggcagccagcactgggcctctggagtatcagatgttacagaatgtcccaggagagtcctgggtatgagccattttctttcctggtacagtttgcatccaccatcattagtttgcacaaataccatatttcccttaggtgtgccctggcattcttcacgtgttcttcgtagttcaaaaatatttgcttttcctggcccaacacggtggctcacgcctgtaatcccagcacttcgggaggctgaggtgagcagattgcttgagctcaggagttcaagaccaacctgggcaacatggcaaaaccctgtctccacaaaaaaaaccatatatatatatactgggcatggtggcatgtgcctgtagtcccagctgctttggcggcttaggtgggaggatcacctgagccaagggagctcaagggtgcagtgagccgtgatcacaccactgcactccacctggttgacagagtgagaccctgtctcaaaaaaaaaaaaaaaa

SEQ ID NO: 7105 - DNA, 461 bp, Homo sapiens
  ENST00000527660
atactgggatgaggatgcttgtaatgtggtgcacactgattaccagagcacagctgagatactgttgggtcctgtctcctcccaaagcacacatcacatcccagggtgcacaccagtaaatgatcagattctggacatggggagccaaggacaggggaaggcagagagaggagcagaattgcaaccactgtcgtcatgaaggaagctagagatcacggaggagaaaactgagatccaaagaagttaaattacttgtccaaagccacttgatgtgggagtggaatgaccgagaggatgtggattctggaaccagagccagttccacatgatggttccagcacacccctcacactgccctctggtgatctactgtctcctcatctcttcctcctctgcagaatggaggaatagcagcacctacctcccaaggttttggaagaataaatgagtacctgacacaa

SEQ ID NO: 7106 - DNA, 1763 bp, Homo sapiens
  ENST00000625113
gtgcttccgttttccgttccgctggcctgtctcgcttcgcggccacctcttccccaacgctacccgctccgtaccctgactcgctgctcctctgtgctggcagagagcgcgcagaacgtagctggacccaagggtttatttaccacattggctggtgtgtccatctgctgtgcaaccacatttatctccggtgagataaaccccatttatctcctagcaagtccctggcgcacagtgagctctgataaaagtacgttgaattggaacctggaactggactaacagctcccaagttcgtatctccgcctcagatctccttttaaactctagacgtgtgcatccatctgcctccatgcatccgcctccatgcatccgcctccgcatccgcctccatgcatccgcctccgcagcacctcccttgggatgcctaatagactctcaaatgttacatgccttctgtattgctccttcccccatcatttcatgcgtaggcagctagcagtctctgccacttttccttgctgtggtcttctgctcaaatatcagcttttcaaagaggtcttgaacaccctaagacagctctgtcatcctctctgctccctggcctttcccagcactctcttgttttgctttattttttctttatgatacttatacctacctgaaattatatgtcttctgcctgtctcccacactctatgaggacaagaacctattctgtcttgttctcctctgcatccctagtgggaaaaacaatctgacacataggaaatgttcaatatttatcaaatgattgagctcctataacaaactcttagtcatcatgccaaatttaaatatttctggacctcagccatattcataattccaaatttagttgtgtggggtggctcgcacctgtgattccagcttcttgggaggctgaggcgggaggattgcttgaggccaggagttgccagcctgggcaacatgcagaaaccctgtctcaaattcttaaaaagtaaacaaatttttaaaaatacaaagaataccaaacttaaatatattctgcaaccaagcccaactttgtccatagattataatgctggtcattgtccctacccccttgacacacacacagtgatggtctagattccatatgatataggaggggctttgacatggtaatcccattggaaggtggtcctgaaggtttattttgcctggaaatgtacaaaacattgagaaaatgtcaactatccgtttgaaggaatggagactgatggtggagatggcactaaaggtcccagccttcctcttagtgccctcacctcttttatctgcctaatccccagaccacaaacctgggaattattcttgactcctttgccactttctaacaatttaccaagcacaagtaattttgcctccaaatatttcacccattcttcttcagtctccgtagaatctgccctatattttagatccctttatcatcctaactcgcaaaaacctcctgaatggtttctctggccagagtttcttctctatcccagccatgtaccccacaggtgctggagtgatctttcttaagtggatatcttaagctgtttgggtccagctccagatcctgctccttttgatcctgctccttttgatacccttttttattccccaccccagggtcccacatcacactataaataattccagtctggctcttatgttgtatttgcttggttacttgtatgtgcctcacattaaataaactgtgagcttctcaa

SEQ ID NO: 7107 - DNA, 731 bp, Homo sapiens
  ENST00000577513
ctggccattactgcgagaagccgaggccaagcggggaccagagaaagcggaccccgcgacgcaggacacgcacctccgttggaagcctaagagtgaggaaaaagggatcacccgctccctcgcgacatgagggcccacctgccagactcttaacaccgattgaacaagcctagccccgcgccagctgggggcagccattacagccgcaaggcactgcgggaaccgaccaggagcgctcctacgattgaacagagcggctgacgaaccagcgagtaggagagagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctat

SEQ ID NO: 7108 - DNA, 556 bp, Homo sapiens
  ENST00000583522
aaagggcccaggcgctacacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccaggaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatga

SEQ ID NO: 7109 - DNA, 556 bp, Homo sapiens
  ENST00000581381
gtagtccccacagctgcgccggtgactgaggggccgggcagtggagaagtggtggcggcgggcggcgggcggcaaaggagcagccatgagggccgggcccagtcaccgaccgaatatcacaggagtgatgctgtgttcttcactgcatgatttcaaaagcctagagttgtgaggtcacaattgcaagtgactttacggtcccctattgagttaaagatggagaagaaaaaggcctttgagcaatggctaaacattattcagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggt

SEQ ID NO: 7110 - DNA, 568 bp, Homo sapiens
  ENST00000584059
catataatgtgctgcttctgaaaatgtctggctggtctccaaccaggcctataaatgggctggctgagccaggccctatgagggcccactctcctcaggaatactgagacattataaatgcacctgtactttccagttgtatgaataggtgctttccagttttatttctcccatccatacatctgtggtaactgaaaaatcattttaaccatagtgatatttgacagcaaattgtcgtcacagataaagatgtaagtatactttcaaccaacacactgctaattaaattgctttatgtgtctaaacttgggcctcacgccagtcatatccagtgttcctactctcttcttcgaatgagttgccttgtgtttcatgaccttgtttttgttcattacagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccga

SEQ ID NO: 7111 - DNA, 462 bp, Homo sapiens
  ENST00000579381
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatccctcttcaccatttcagcatcagtggaggcaggacaaagaaaactaatcaatgtggataagtgtccccttccatactcctgaatgaggtcaagcttcccccttgcctctgctaaaaaaaacctcagagttggtactaacttggaacaaagggactcttctactcatcaaggggacactacacagaaaatgagaactg

SEQ ID NO: 7112 - DNA, 4033 bp, Homo sapiens
  ENST00000341217
tcttccttgctgtttcctctagcctagagttgtgaggtcacaattgcaagtgactttacggtcccctattgagttaaagatggagaagaaaaaggcctttgagcaatggctaaacattattcagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcgc

SEQ ID NO: 7113 - DNA, 720 bp, Homo sapiens
  ENST00000577376
agtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccg

SEQ ID NO: 7114 - DNA, 549 bp, Homo sapiens
  ENST00000577682
agtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagc

SEQ ID NO: 7115 - DNA, 598 bp, Homo sapiens
  ENST00000581229
acagctgcgccggtgactgaggggccgggcagtggagaagtggtggcggcgggcggcgggcggcaaaggagcagccatgagggccgggcccagtcaccgaccgaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctat

SEQ ID NO: 7116 - DNA, 2836 bp, Homo sapiens
  ENST00000452648
agccggctgggggagggggtgtcggcgcaccgcggagtcctgcgctccgtgagcctggcacccggagcagccgcctccccctccccctgcctagaccgctagaagccccctctcttccatcctcccggggcgggggtgagctgggctcagctgcccaaggcgggcggggcggagccaggagccccacggagcgctgcggagcgaacctcacctttccagggcgcaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacacc

SEQ ID NO: 7117 - DNA, 886 bp, Homo sapiens
  ENST00000583307
cgggcggcaaaggagcagccatgagggccgggcccagtcaccgaccgtgctgaggagtcatggaagagtttttaaaccaggaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccc

SEQ ID NO: 7118 - DNA, 561 bp, Homo sapiens
  ENST00000582059
ctttccagggcgcaaggtgtgtgtgtgctttttctaacgcgaccccgacttcagccgacttaacctttgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagag

SEQ ID NO: 7119 - DNA, 564 bp, Homo sapiens
  ENST00000583953
gattgaacagagcggctgacgaaccagcgagtaggagagaggtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccct

SEQ ID NO: 7120 - DNA, 2613 bp, Homo sapiens
  ENST00000582266
cacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaa

SEQ ID NO: 7121 - DNA, 4161 bp, Homo sapiens
  ENST00000581407
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctc

SEQ ID NO: 7122 - DNA, 2494 bp, Homo sapiens
  ENST00000329759
tggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccctaccacagggccgctcccagtagttttattcttcgatcttgcccgggccgagcctggcaggggccggtggctcagcgggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaa

SEQ ID NO: 7123 - DNA, 546 bp, Homo sapiens
  ENST00000412306
gaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagaaagtcacacaaccacatattttctgaacataagctgaacttctacttccatggagtgagttacttcacctcattggcaaaagacaacagaagagtccaaagtctgaggggactgggcaagcttctgtcacatgctttcagaatgaagacaatctgcaagaattttaagttgtgacctctacagagaaaagaatgaaaagtagccaaatctccacatgagagattttggactattttgcagtgtaaaccccatctgatttatatgaagtaagcagactttctctccaagagttcaaaataaattaattctaatgctaaa

SEQ ID NO: 7124 - DNA, 5664 bp, Homo sapiens
  ENST00000369754
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 7125 - DNA, 5609 bp, Homo sapiens
  ENST00000320172
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 7126 - DNA, 5537 bp, Homo sapiens
  ENST00000369756
atgcagatgaggagggtgtggcgaacgtgccgctctgggccccggaagcgcagagaagcccggtataaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 7127 - DNA, 356 bp, Homo sapiens
  ENST00000423467
accaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggc

SEQ ID NO: 7128 - DNA, 5751 bp, Homo sapiens
  ENST00000369448
ccgaggggactggctccgccacgccccgcccctggctcccccgggagggcggctcaggggcggggacgggggcgtggtcccgccgtataagaacggagggggcggcggcgggacggctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagacaatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgaccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataatgtttaattagaattgtggtggtggtagtggaaggggataattgtaaataggaaacatgaatgttcatttttttctttaaagaattcttattaaatggctccctgccttttttttcttttttcctcatcagctctttcatggctgaattttgttttattcttcctaagactgaggattgtgctgagtccagagtcattgtggtaactgacatgagggtcttcccatgttttaactggaaacccactttggtcacattccaagtatgacacagctgttcttctggagtactttagctattttttgtttttgttcttttcgttttttttttttccaaaaatagtgacttccttctccaggtgtgtttgacagcaactcaattcaggaatttcggtagaactgagtgacctgtggaactgctttagaatctaacctgctgtcttcgtgctctgtgtgaaggggaagctggggggttagcatgaagtctggccttgtgtgcattggagcttccaaggcactttgaaatcattccagtatatttgggaagaattgagtgaatgagaatgctcttccttattctggtagatttgacttgtttataattctgcactttagaagaaaaacagtgttaatctgtagttgaaagaaagcttagtagatgagagagttctaggctactgtggctttttccagtagatttagatgagattatgtgttttgaaatgttttgtgggatcccttagaaagcatcacttcagggcagagacactcaatattgccagccagcttgggttctaaagtgatttaatcaaattcatgctcctgatcttttttttcccccttcctttggctatgaaaacccaaagcccggagtgattgttttctccttgctttaagcagtgaagttatcctaatgcaaaagagcttagtagaaaatgagtggtttacctttttttctaaaagtatattttcaagtttattctggaatgtgatgtcttggtcctcttaaaagcagatcagccatgactgaaactcaaggcttagctggtatctatgttgtgctacattaggtgactagaagccacttcttagtgtaatcagctcctgtttccctgtgagccttagttatattttaattcagtggctttgagtcaaggccggttctaattgaggggacccagtgtgcttcagtgttaagagtggggcaatgaagagtgaaccccaatgaagagtgatcccaactttggaaactatctggtcattcatgaccttaaaaagctgccatggtggtcaaatggcatgtgtttgcacaaaaatgaccgatgtgtttaaccaaagctttgaaatgtgatgaagccaccaacataagcacttgcctaacagaaatcagtatttcttctacttagaaggcttggggcccagggtaatgaggcaccagatgaagataagatctgcatcaaggaattaaatttccagtttgtccttggggttctttctgcttatgttttttcccccccatctggtaatagtcctcttctgagaatgaaaggaggcacagaagttgcgagaaagacccagtccccagtctttgccaccattgcaccatggttgtctcggagtcccttcacctgacctttttagtcagctcagatctttttgtagtttgagaatagacctattcaagagctatcagggttaaaagctgcactgaccaaagctgtacttttaaaacacaacccctgggctagtgatgtctctacttgctctatgagccttttgccagcctcagaataggcgaggtaaccttgaatttcagggccctggaaactctagctgaaacctgcctttcctaatgctcacacaagcaccaggtaccctgagcttatactgagtccagtggttcctattttatgtgtgtgtgtatgtgtgtgtgttgagtaacatgaaacttggcagtagcagagagcactgaagttcacatgcaagttctaatctaaagttaagcagtctcttatttgtttcgggactctgatttgactctttttctgatgctttcggcatgtctgcagcctgttctcctagcctgctgcttggagtcaggttgagcatcagtgagatgaagacagtaccttttcctctcacattggcagaatagcacgcactagatgcctgaccttgagctctagtctcccctttaaatcttaccttggcagtaacacattattcctcattcaataatttcaatgctgaaactgaactctattactaatgccttccaatcagagttcctgatggggatgcctgtgggatggcccacacctgggggacctggcagatggggtgagttgggtaaggaagatgatgcttagttcctgatagatgctacagatgtagtttggcatttcagtttttgtccagtttgattttcactggggtttgagtcacagcaagctgtgtatgaacttgtgttttgtggtgacacattaataatcaaattgctaaaaccctgaatctgcttattcttcagcttcacctctgcactaaccccttacccttatggtacgtcaggattttaactagtactgctttgttgactttgggaaatggtgccactcaaaagcaacttcctaacttgaggaataactcctttgtagtttactttctggtactggttggtgccttgtattgggatacagctatattcttagctcaaatgtcctctttttgagagcaaagtagttatccaatggtgagacgagaccctgacgctcatagaggccattccttcctgggtgtcggaccagggctctgtgtcagggaaaaccttctgggtggactttgtaagaatccagtttccaaggttagattcacatccttaatcttgcagagactagaatttcacagctcgctttggaacatattccaattcaaccagttaaaatcagaggaccaagtcgtgggggaggggggcggtgttgaggagaggtatttttaaagatctggcaacttttcaggattatttgtggagaactctaaggttaagatcaggaaataaaagactgtgtgtgtgtgtgtgtgtgcgtgtgtgtgttcaagtgcctaaatcttgtttacctatcactttaaaaaaataattgaagtgtaagctaaataaaatgcttggagttttgcctgggctagtgagagttggtgcaaattcttgtgtgtgtttgcataggaaggtgagatgaccatctactaaagaggaagtagctaaatacagatctgtgggtgtttttaaaaaaactcaacctatctggtgttttattttaatggataaaaatgtaatttttctaaggtagcaacttatttccaaattaatatagatgaaaaatagataccaattagactaaattgaaagctttttgttctatatttgcatagcctttgaaatatttcttagtgcctaggaggtctggggattcctctttcgtggtggtcactaaccttacttgatgcagataaaatcacttgtcaatgcaaaatgtgttagaacttgataaagctttgagtttgagaaataaaggtatatttaaaatttaaataaaa

SEQ ID NO: 7129 - DNA, 3798 bp, Homo sapiens
  ENST00000519824
gtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaagtgtggcttggtttactgatgttttgtttttaggcttctgaagttttccccatgtatgtttttatggaatgcatatatacattacatgattttttcttcttttaggggagagccgggtcttttcattagaattttgatcattgtctatgtatatacttttaattgcctttaaaattttgctaagtatattaagaccagtgatcttttcattaactggacttttattcttgatttactcttgtatggatgtagtaatggaaggaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttggaacaaactacttaaaggttgtctagttcaaccatgccagtgttttaaatatttaggaatatccgaggtataatacaattaaaatgtttaaccatggaagagaatcacagaggcttccatcagacccttctggattaatagggccagatcatggcacacacagcttctcaagatcacatccctgctgatctctctggccctcctgatcactgctcccccacttcacaccctgtcctgcagccaggccctactgcttgctgttcacaaattgttccatgtgatgtcacttccttagctctggtctggctggtccctgaacctgacattcccttcctccccttgtgaccctctaatgaacgccaactttcatctttgaagggttagcttctattacctccttcatgaagccttctggataacattggccatatccttctaggcatcttctaagaatagtgtaataggctgaatagtggcccccaggagatacattcactgggaatctccacgtgtgacattatttggaaaaagtttttgcagatgaaatcaaggacctggaaatgagatcaacctgtagtagggtgggccctaaattcaatgactagctcttagaaaagaaggggaaatagacacacagagctgaaggccatgggaagatggaggcagagattagagcaatgcatctatgagccaaagaaccctaagaattggaggaagtcactagaagctaggaaaacaggcatgtcacagattctccctcagagtctcgagaaggaaccaaccctaccaatatcttgatttcagacatctggcctccaggattgtgagggaataaatttctgttgttttaagccatgcagtttgtggtattttggtacagcagccttaagaatctgatacatgtatctcgtaaaacacctctgatacttacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactgaatgaatacaaatcaaaaataatgatgcagcgggaatggatgcagtaagattgctgtggcctatgcagttcacacagttcacactctgcatgttgaggagtaagtggacagatctcttaagcccaggggctagcaaaccggtctgtgggccaatttactcaccgtctgtttttgtacagcttgtgagctaaaaatggtttttaaaaaggttgaatacaatcaaaagaataatattttgtggcatgagaaaagcatatgaaattcaaattttagtgttcataaataaaattttattggaacctaa

SEQ ID NO: 7130 - DNA, 2196 bp, Homo sapiens
  ENST00000522746
ggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 7131 - DNA, 1968 bp, Homo sapiens
  ENST00000523509
ccgcgccgcgctcccctcgcccgcccgggccgccaggagaagaaactgaggcctggaatttgattaactcattcaaggttacccagttgatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 7132 - DNA, 2024 bp, Homo sapiens
  ENST00000401979
aaacggcggcggcggcggcaccggaggctccgaggctcctgcgctcccgcgccgcgctcccctcgcccgcccgggccgccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 7133 - DNA, 1902 bp, Homo sapiens
  ENST00000519110
ggggaggcgcgtcgcgaggcgagcgtcctccttttgtgcgagcgccggcggctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 7134 - DNA, 4552 bp, Homo sapiens
  ENST00000523288
gcgatgcggcggggactgggcgcggggggaggcgcgtcgcgaggcgagcgtcctccttttgtgcgagcgccggcggctcggcttctcgaaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagaggtaagcattgcctaggcaggtactctgtgttgttatttatgcccctgttggcagacgtgatgtcagcaagcccaagacattaaataccatcttgaaaccaacagactcccagatgtatgtgttgagtcctgacttttttctgaggcccacatgtgcacacctgtccacgtatttgcagtttctctggagggatggtggaaacctcagtgatagctgatggcatggccaaaccaaactctgggttgcgttttctaaccctgccctttctttagtttttgctttctcaattaacagtaccagtgcaggcaaaaacttacaacttatgtcatcctaaattcctttcttttttttttgagacagagtttcactcttgttgcccaggctggagtgcaatggcgtgatctcagctcaccacaaactccgcctcccgggttcaagcgattctcctgcctcagcctccctagtagctggggttacaggcatgtgccaccacgcccggctaattttgtatttttagtagagatggggtttctgcatgttggtcaggctggtctcgaactcccgacctcaggtgatccgcctgcctccgcctcccaaagtgctggaattataggcatgagccaccgcgcctggccatcatcctaaattcctttctatacctcactccctacatgtattccatcaaacagtctcattggctttccctccaaaatactaatatatcatgattctgaaaacttaagttgctttcttgccaccagccacatcagacttctcatctggattactgcattcgtgtcctgaccattcttacttcctccactcttgccccaatatagtcctttctccatagagcaaccaagtaatcttaaaacataaaccatgttccctccctcctccatgtaaaatgttcccagtgacttcctagtacccttaggataaaatccaactatttcatagcctataaaactctacacctttgaccccctgtctgcattgttgcagttgttcttacattgctggaatgcaggtgcctttcagaagagtcctgccttcgctgtcttgctcatagctgtatccccagtgcttggaacagttgcttagagtctagtgcattatttagaaaattaggagtaggaaccaggttttaaagttgctaatttttcatattacgctaaattttaaattgtgcttaagtaataacgtttgttacttttactttttttgttcttcatatacttctacagaataaaaatttaccaatagaaaataccacagattgtttaagcacaatggctagtgtatgcagagtcatgctggaaacaccgtgagtatcagctgatctttttcactttaacagtgctgttgagatgactgatatttcaaaacatgttcatatatgaacatgttaacatgttttatctggaaggtggaaagtaagtatattccaaatattgaatgttaatatatgaacaaacttaaaataatttggctatttaacgtaacttctggttaagtataaaatagagttagttggtcttcaggtacctcagaccactcagactgactcagactcttagttctcttctcagaacagaagtggtggtggtgttttggtggctgggatgtaggagaagaactttaaagttccttggttatacttaccataaatgttctttttccatatttagtaaagaatcttacccttttgccaaagggctggaattattcttctgtttatccctttttctctcaataattaattgtcactcttttcttttttttttccaacacgaacctgaattctgtttttttttctctcctctctaaacatttatgatgtatgatacagtgtgtcctggctggatttttcctgttagcaggcagaaagaatccctcctggattccagaataataaatacagtcatgtgctgcttaatgacgttttggtcaacaatgggccacatatatgatggtccaaagcactatactgtacatcatctcattggaaaaccttatgaaataggagggcaactatcatcataatcatcttccttccccccaccaccaacttcagggagtgaggtcctgggaaatgaagggacactatccatgtgcttggatgtctctatcctggttccgtactctttccgctatgatatactgccttctatatatagataaaagttcaattttctttttcacaaatgagaggagaatatgattgagttttagtaaaattgatatccagtaatactataatgtatttagatcaagttagcacctaaatagcaaacctgcttgctctattaagctagtgatttttcactataggtgctaacaaccattacgtagcatctattctctaaaattgttgctatcggtctagcagaggagcagtgcactaatgtgggtgcagatattatagaaaccagaatacatgggtgatgactgttccactcaccatcttctcatatctctggggatctcattgtggagtaaggggcataatgttagtataccttttagagatcaaaggggcaagtcagcatcagctgaaagttgaatcacctcattaaagaattttatatccctttcagggggttgatttggaaaggaaaacagacataagatttgaatgtatcagtgtggctacttgtgaacatactgcattcaactaatggatagaaatttgaataaaatatttcagaagaggtttttcttgtgtgtgtgtgtttttaaaaagaattttgtaatgcacttcttccatgcatatcttatctactcttcagggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 7135 - DNA, 1647 bp, Homo sapiens
  ENST00000522250
tccccctagcgccgctgaggagccgcctctgcggctccaggagggcgcaggagcgggactgagagcgcctggaggctcgagcggaggatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 7136 - DNA, 1817 bp, Homo sapiens
  ENST00000517654
aaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 7137 - DNA, 2021 bp, Homo sapiens
  ENST00000519540
cggcgccctcacttcctggcattccctcctccccctccccgtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataa

SEQ ID NO: 7138 - DNA, 1700 bp, Homo sapiens
  ENST00000522941
ttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttga

SEQ ID NO: 7139 - DNA, 640 bp, Homo sapiens
  ENST00000520887
taatttttttgtatttttagtagagacggggttttaccgtgttaggcaggatggtctcgaactcctgaccttgtgatccgcccgcctcagcctcccaaagtgttggaattacaggcctgagccaccctgcccagcccattctgtcctttaaatcgccactcagcaccttttccagaagtcttcccttagcaaaccgtttgtttttcattgcatgtgtggtatattagtttgactgattttgttctcaaaaagattttgttttcactaagtgagaataataactcttaggttgggtttttttctgttctaagaataattaatttgacatagtatgtaatctcttgagttccatagttatggtcttgatttattttactattttgaaaaggaatgttacatgaaaaaaatggctgttttaccttttctgttttctttttctttagatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgca

SEQ ID NO: 7140 - DNA, 791 bp, Homo sapiens
  ENST00000517801
gcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccgtgagtatcagctgatctttttcactttaacagtgctgttgagatgactgatatttcaaaacatgttcatatatgaacatgttaacatgttttatctggaaggtggaaagtaagtatattccaaatattgaatgttaatatatgaacaaacttaaaataatttggctatttaacgtaacttctggttaagtataaaatagagttagttggtcttcaggtacctcagaccactcagactgactcagactcttagttctcttctcagaacagaagtggtggtg

SEQ ID NO: 7141 - DNA, 696 bp, Homo sapiens
  ENST00000519142
gaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaaggtagaattatctattggccctgattgtt

SEQ ID NO: 7142 - DNA, 820 bp, Homo sapiens
  ENST00000518879
cgcgtcgcgaggcgagcgtcctccttttgtgcgagcgccggcggctcggcttctcgaaggtaaacagcgcttcctcttcctcctcgccgcgcctcttccttttatagttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgggtcccaccctgtcgcccaggccagagtgcaatagtgcaatcacgacccactgcatccttgaccttttgagccaaagcaatcctactgcctcagcctcccaagtaattcatttgcacacctgttagcaagaaacagaagttgaaggactggaacaagtgaactaggaaagagggaacgccaatccaaggatagaaggacaaggacagaatcaccagcactggctgaaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaag

SEQ ID NO: 7143 - DNA, 544 bp, Homo sapiens
  ENST00000522702
gtgcgagcgccggcggctcggcttctcgaaggagaagaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagc

SEQ ID NO: 7144 - DNA, 587 bp, Homo sapiens
  ENST00000521223
ggaaacggcggcggcggcggcaccggaggctccgaggctcctgcgctcccgcgccgcgctcccctcgcccgcccgggccgccaggagaagaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaagatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattct

SEQ ID NO: 7145 - DNA, 699 bp, Homo sapiens
  ENST00000520204
tgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttag

SEQ ID NO: 7146 - DNA, 574 bp, Homo sapiens
  ENST00000518283
gtgcgagcgccggcggctcggcttctcgaaggagaagaaactgaggcctggaatttgattaactcattcaaggttacccagttgataactgcagcattggactagaggtggagagagtggtactgggggagtggtgaagcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagag

SEQ ID NO: 7147 - DNA, 581 bp, Homo sapiens
  ENST00000523993
aggcccagtaagtatctgcgggagggctgaatgggtgcgtggacagcattcctctcactgaccccgctgcgaggtgagccaggcaggggctgtcaccattcctgaagtccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaatttt

SEQ ID NO: 7148 - DNA, 579 bp, Homo sapiens
  ENST00000520254
catccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggc

SEQ ID NO: 7149 - DNA, 573 bp, Homo sapiens
  ENST00000519020
ttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaagttcctcctaacaggaacccagctggcaaagatgtctgggaaatgtcatttgcattctcagccccagcagtgcagaaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccag

SEQ ID NO: 7150 - DNA, 421 bp, Homo sapiens
  ENST00000518167
ccgccaacccggaaacggcggcggcggcggcaccggaggctccgaggctcctgcgctcccgcgccgcgctcccctcgcccgcccgggccgccagatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagag

SEQ ID NO: 7151 - DNA, 548 bp, Homo sapiens
  ENST00000517672
ttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaata

SEQ ID NO: 7152 - DNA, 561 bp, Homo sapiens
  ENST00000519070
ttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaagg

SEQ ID NO: 7153 - DNA, 367 bp, Homo sapiens
  ENST00000522361
aaacggcggcggcggcggcaccggaggctccgaggctcctgcgctcccgcgccgcgctcccctcgcccgcccgggccgccaggagaagaaactgaggcctggaatttgattaactcattcaaggttacccagttgggtggtgaaaacagtaggtattctgaaccaaccttgcacttctcagatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgc

SEQ ID NO: 7154 - DNA, 554 bp, Homo sapiens
  ENST00000518344
cgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaaatatgtctttgggggaaatgattattcaaatataaatgaaaagttatgatttcaataaaaacttatattaactatatataatttaagggaaatgttctatacacaatattgagttgctaaaaatgttgttaggaaatattgattgtttagtttttggcttagaataggacctggtggggaaaatgtaaattaattagaactttttttaacagctttctttctttaggagaggtatgtgttttcctttgaattaagtcattttagctgtcaccagtatagttgatcaagaaagttctaagccataattttagtagtttaaagtatatatatgtacatatatatttttt

SEQ ID NO: 7155 - DNA, 533 bp, Homo sapiens
  ENST00000523514
gagcgtcctccttttgtgcgagcgccggcggctcggcttctcgaaggagaagaaactgaggcctggaatttgattaactcattcaaggttacccagttggtaagtaacagagctggaatttgaccatggtcatctggctccagagccagcactcttaaccacacttcctatgaggaaaaattaaagtggatggtgatggctacaagatggatttcagttgcatagaaataagaacctcctacctctgttgaaatcagaatacatatacaccccttcattcactctatgaatattcattcattccatgaacctacaaggtttttaggtcaaattattagtttaaataagaactataggctgggcgcagtggctcacacctgtaatcccaacactttgggaggctgaggtgggtggatcacttgaggtcaggagttcaagaccagcctggccaacatggtgaaatcccgtctctactaaaaatacaaaatttactaaaaatactaaaaatacaaaatactcacttgaacccagga

SEQ ID NO: 7156 - DNA, 507 bp, Homo sapiens
  ENST00000518285
atttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttggtaagtaacagagctggaatttgaccatggtcatctggctccagagccagcactcttaaccacacttcctatgaggaaaaattaaagtggatggtgatggctacaagatggatttcagttgcatagaaataagaacctcctacctctgttgaaatcagaatacatatacaccccttcattcactctatgaatattcattcattccatgaacctacaaggtttttaggtcaaattattagtttaaataagaactataggctgggcgca

SEQ ID NO: 7157 - DNA, 750 bp, Homo sapiens
  ENST00000615041
atgcagaaggcatcttggaggacttgcagtcatacagaggagctggccacgaaatacgagagggcaatccagcatccagcagatgagaagttgcaagagaaggcatggggtgcagttgttccactagtaggcaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattacaatgtaccgggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattccttgagggtaatggtgggtgtcataatactctatgaccacgtacatccagtgggagcatttgctaaaacttccaaaattgatatgaaaggttgtatcaaagttcttaaggaccaacctcctaatagtgtgga

SEQ ID NO: 7158 - DNA, 837 bp, Homo sapiens
  ENST00000639004
gatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagagggcaatccagcatccagcagatgagaagttgcaagagaaggcatggggtgcagttgttccactagtaggcaaaaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattccttgagggtaatggtgggtgtcataatactcta

SEQ ID NO: 7159 - DNA, 628 bp, Homo sapiens
  ENST00000489029
ggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccaggttgcctcacggactgtttcaccaagtatgttgccatgacatagcacggccctccatcttcccatcttcacggcatctgacagccgtctcctcactggtcggctctatgccaagcattcgtgacacacgtcagttctgttgtggtggcaccatcgcagcgacttctctcttggtgaaggagttgctgctgctcacca

SEQ ID NO: 7160 - DNA, 2776 bp, Homo sapiens
  ENST00000489363
cgggcggtcgtgggcgcggggccctgcgctccgagctgggcgcgtggactacgtccccctgcctccgccgtctgcgccgcccgtcgaggcgacttttccgcacgaggcgaggcccgccctggtggccccgcgccgtggttcggtggcgcgagaggcggggagtcgccgtggtaaacggggccttggggcgtcccgaaggggacccagacgcgggaggccagacttccccggcgacccgaggaggggacttgcggcggattccgaagccgctttttctgcgtagcctgggggtgtaaatcgccgagattctcctgtgtggagaaggcgccggtgcccgcccgctgctgccggactctagaggggtgtctttttccgttaatctgagcgcagtcgcggagcccctgtttcccacgcagcctgtgttaagtggcctcgcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagccgcacagctgtgcccgcgagtgcgagtcccgcgtccgaggcctcggcgtgagcttacagcatctgtcgggtccgagcagtcagtccagagggtcgactctgaatgaaaacaaaacgccgtggtttgaaatggaaggaaacctggcccctgaagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgcaaa

SEQ ID NO: 7161 - DNA, 2159 bp, Homo sapiens
  ENST00000461064
gcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaa

SEQ ID NO: 7162 - DNA, 2086 bp, Homo sapiens
  ENST00000472884
ggttcggtggcgcgagaggcggggagtcgccgtggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttgg

SEQ ID NO: 7163 - DNA, 811 bp, Homo sapiens
  ENST00000467215
aaagccagaggctttggcaaggggcaggtacagatgtggctgagacagggccctggacgtttgctgagtgacgtcaggtcagctcgtaggaggcttccctgaccttccagggtctcaccggcttccggtagctgagttaacccacctcaggtgctggaggccctccagctgtcagctggggtccgtgcaccccccagactgcctggagggcttcgcacacagtttgaaaggcctctgcgctttggagcccaatttggaacttgaaggcttgacctttgtgttttggacaactgttttgtgtttaacctcagatggaagtgaccatccaaccagagtgatggtagcaggagctgggacggagccccggggctggcgcccagggacagggggcgcgaggcggatgggtggcgcagtccaggccagcatcggccccgtgggcctcggtttccaccgtctctacagcgtgggtggccccttcagttccgtgtggccttcgctagcgctgttgggcgctgagctgtacagctgccgtgtctgtgggcagaagttttttctcctgcaccgactgtgtcgtccagaggcgttcagagcctgctgttttcacgctctagccgcacagctgtgcccgcgagtgcgagtcccgcgtccgaggcctcggcgtgagcttacagcatctgtcgggtccgagcagtcagtccagagggtcgactctgaatgaaaacaaaacgccgtggtttgaaatggaaggaaacctggcccctgaagactttaaaaaattcaaaaagcctttgctccctcaattacgaagatg

SEQ ID NO: 7164 - DNA, 558 bp, Homo sapiens
  ENST00000463238
gtcgccctgagcgagcggggcctgggcggccggcagtcttctcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagc

SEQ ID NO: 7165 - DNA, 2802 bp, Homo sapiens
  ENST00000308132
tcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgcaaacagattaacatgcgtctgtgttccccacgaaaggcctgctgtgcagggcgccttgtgtgctttagttgctaggaaaccccgggcgttggtggtcagagtcccactggccccgtgtgtccccccctcccgacgggtcacggtgcttggggcttgcgcatgggcatctgtgcccatgaaccttgtcacccacgtgccagtgaaccgccagcttgtggccgcctggttttccaccggtggcagtgatggcctttggggcagaccaaggtgccatgagtccctgcttcccgtggcctgggagggcccttgcaccttcaggtggggtgtagtgccagacctctgggaaggctgtcctgccggcagcacccgtcagcacccactctgtgaatttaatacaaggcctttgctttgtgcatacgacttctgattaattttcgtttccaccatctgaagtgggcctggctgcgcctcaggcctctggtctctggctcagaaccagacaaggcaagggatttcctgtttttcattcttgcacttttaataaaatcgtaggggtttcgagtttgcgatagcaaaagaaaacattaa

SEQ ID NO: 7166 - DNA, 2574 bp, Homo sapiens
  ENST00000370310
ggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaata

SEQ ID NO: 7167 - DNA, 2426 bp, Homo sapiens
  ENST00000616709
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 7168 - DNA, 2468 bp, Homo sapiens
  ENST00000613902
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccagtgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 7169 - DNA, 865 bp, Homo sapiens
  ENST00000615519
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggaccagcaccggtaattgtgccaaacttttgcgaagcactgctccagacagcaatcagtgatgccaaacgtcggtttgttcggaacacgctatgtcccacttcgaaaacctagcctcaaataacaactacgtacctctctcgcttcccatgttatgtttttcaaaagcctaaattacctgccacaaagcttaactgggcaagagcacattcagcagtaattcccccactaaaacagcactgttccccatcagctaaagcaacatttcatcccacccttggggccctaccccaataatt

SEQ ID NO: 7170 - DNA, 2646 bp, Homo sapiens
  ENST00000613047
aatgcaaagaggatcctattgtgcagctttacactttgcaagttgatatgcaaagagtaacttatttttaatatatcttaacccttctccagtcatttctcctttaacaattgttagcgtctcctcagtttccagaatatctattcggtgaaacatttggttcgctgaacaagaggaacataaagccctggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattccggccagttacacaaaactccttccccccaggcctgagaagccatcagtatgtgatcactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgtaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagaaccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaaatatttccca

SEQ ID NO: 7171 - DNA, 2475 bp, Homo sapiens
  ENST00000619304
aaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgta

SEQ ID NO: 7172 - DNA, 2361 bp, Homo sapiens
  ENST00000619850
cgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgta

SEQ ID NO: 7173 - DNA, 6355 bp, Homo sapiens
  ENST00000295092
ggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaactatagaatttacgtatgttacatttttaagtatgagttaaattgatataaagtgttcctcaatatttaataatgtaagctgttgtcatgacagtattttttaaaaataataacgtatattatagttacgaaacacttgtgccagattagaacatcaagcacagaagcagctgtatgatttacctgtttttttgaaactttaatgtttaccttcccctatgtttaatttttctgtggtgaacacttttgttagaacatggcttttttatttttcttggaaaaatatgctattagtatttacaaaataattaattacctgaataagcagtatatactaaaagtcttcaaacattactttattgattacttatgttttgtggtgcgctttcaacatccctaagagttaaatgtcttagtcatctaatacatggaacagggtcaaacttcaatgaaattaatacttattgcacaatcataatatagcaacctaattttcttttatttataggcatatctttaaagctttcttctcttttttgaacaaatgaagagaatccagttagtttttgcctttcagaggtgatttgccacgtgcacaaagggtctgtaggtgaaaagacaggcttttgggtttcttgaaacatcaaaaactgaatttagagaatggttatctaacactcaagtcaatgttttttttgaaattactagctattggtataatatacatatatgtacatgtatacatatacatacacacatatgtacatttacacatatgtaagtatacactcatatacatatatacacatgtatatatacttgtgtacacatacatttttgcctatagctagcaattatttcattcagatacacacacacacacacacacacacaggctacttaaaatagagagtgacttgagatatacaaaaacaggaagaaaagccctggaggtcatatagctaatgtataactgcacagcaagcagctatgtctaaagctaacaataaaaagaaaatgtgggagttgtgcaattagttttattctcattttttggaagaatatgttcctggtttctctaactaaaaggaaaaaattcaaaggaaagttgtaaatattaggaagtaactgaaaaataagaagcaagataaagtggggaggctatgagatcatataatgagctaataaacttttcaacaggggacacctgttctcccttctaactgaagacactaaagagaagctaagatcctatctttcaatcatttagtaattcataaaatcccattatttcataactcaaagtttacctttgaggttgtatgtttacctcatttgaactcgaaatagaagaggtttaagtatttgaataagttgggaaaaaaaggaaaaatagtcttccctgcccttgtcactgatggtgacactacttgtaattactgtattttttggcagaacactcagatgaacagattcctatgctgtggacttttatcattctttttgatggctgatagtagaaagcacacagtaggtactccataaatgtaagactatggcagctgtctagtacaagtgcttctcactgattcttggttaccaggaaaaccagaaagcccgtcacttgccttgcctgcaaaggcgagcctaaagaaatttctctaaccaaaattggcaggttctttccaccacaaaaggctcttggaaatataacttatggggcttaaggctaatttgagttgaagggtatttgtaatatttgatttgcttttagcagagaaaacaataaaagaatccaggaaaagtagaaaa

SEQ ID NO: 7174 - DNA, 3765 bp, Homo sapiens
  ENST00000331243
gtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggcccacccctcggtccttcctgggtgtccgtctcccacactgccacagccagcactctcctccccaccgggaccccgcaagctctccagccagcctgggtgttttcttctgggagttggaccgagttcccggaaggggtcggaggctgtgtggtggcgtctgctctcgcctgacctgtggcggcttctccgcccctcgtacccctggggaggcacggaggactcggctggaaagggtgactccgatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgtt

SEQ ID NO: 7175 - DNA, 2053 bp, Homo sapiens
  ENST00000497769
acagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcgaattttagagttggatctttgtctcatggatgctcttaggagacccaccaaccaccaactccttgtattgcaactggaccccctcgacctgggtgaatgtactcttttcagcaaccatatcctccctcctgttgccaggtaaggtgagaagcaattcctctgcctagaagctctgccgggtgaaatatcaggagatcccacccaagctttctcttgcgtgtagcctatatccagcacgggagcataggctaatcctgcagttggccagcctcttgtcctctggatatcctgggatggaatcctaatgaaggaaactccagtggtttactgaagccctttgtgctaggcctgaggtgagatagaattgctccatcctatgcccaggaggcctgcgtggactcacagtgcaccaccatcctcagaaatcctctctccctgtaggctgtggtctgaatctttgtgtcttcccaaaattcatatgttgaaatcctaacgccccaggtgatgatattagaagatggggcctttcaggagttgactaaaacttcagggaaaagccctcacaaatgggattagttcccttataaaataggtccaaggaaacttgctcacttctaacaccatgtgaggacacagtgagaaggcaccatctataagccagaaagcagtccctcaccagacatagatctgctggcaccttgatcttggacttctcaccctccagaactgggagaaataagtgtatattgtttataagctacacagtttatgatattatagcagcccaaacagacattgtatttcctcaatgttggtttaagagttgtctgaaccagtttcttgttatcatactgtggatgtttctagctctcactgtagcattccacctcttttctgtctcagtgacttagtcaaagcatctagttgaacactctgttatttaaagaaaccagcattcactggctgttcccagctccaggaactcaggtggattcataatttgttctgtttccttgctcttaggaaaagtactgacagctcataattggttgtatttcttaggatatttgcatttaaactagaagcaatgctttcttttcttggtataatttgtcttacatttttgaaagtaatagctattcattaaattacatttgaaaatgcaggaagaaagaaaaaattgtctataattctactactcatataaaaccactattcacatatgtgtactttcctctattaacctttcaaagcatgcctcaattttaattgtattcacacaaatacaattttatgccatacattttacttattaatatgctattagcatcaccaatgtcaatataaactccttgtaaacatcaatttaatggttgcaaagtattacatcaactggatatgccatggcttatttaatcactgtatttattgttaaatatttgcattgtttacattgtttagtattgaaaaccacgctgcaataaatatctttggataga

SEQ ID NO: 7176 - DNA, 677 bp, Homo sapiens
  ENST00000464947
gctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtctactggggaaggctctgtgacttgctcttttttgctgctggaaagtctaacacttgcagtaggtgctaaattagagtctattcactcaatggaggaactggggaagaacaaaacccatttaatgttttcagtgaatgcctggggtatttatatcaaagttctagtagtggccagttaatgaagatgagctcttaatttttcacaatgatctaccttagagagaaacagaggtgcatctgttggataatagtcaaggcgtctgtgtcggtaaccaggggtccaagaattttagagttggatctttgtctcatggatgctcttaggagacccaccaaccaccaactccttgtattgcaactggaccccctcgacctgggtgaatgtactcttttcagcaaccatatcctccctcctgttgccagcctatatccagcacgggagcataggctaatcctgcagttggccagcctcttgtcctctggatatcctgggatggaatcctaatgaaggaaactccagtggttt

SEQ ID NO: 7177 - DNA, 1495 bp, Homo sapiens
  ENST00000366654
gcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatc

SEQ ID NO: 7178 - DNA, 1576 bp, Homo sapiens
  ENST00000494111
gagggactcagcaggagagtagatctaggattccagatgatcttcttccatggtttttgagcacatactatgtgaccccgagagagtgtggctttctcgattaaagttattatttcttttatgaaatcctagcaaagatagggacgtcagagctggccgagtcagactcctgggggcatgttgatggcatccagatgcaattctgcagaggaatcctggaaaacaggagtaagtctagaggaaaggccacgggtgttagtggacgagaggtcataatgaaaataggggaagggcctgagatatttagcttggagagaagaacacaggtttggtttttgttttagggcatggggtggtggaaagtaaatgaccttcagattaaagggtagtagttaggagagagttaaattagatctgtttggatgctcagctgtcacacccagcatcaagggctctgtggggcctccaggctgggaggctttgactttgtataaaataatcgtattggtttggagaggagtgcagtggtttggaaggtcctccttttggggtttgagctgagcaatttatccacagtttctcagctggtgagtggcggagccaagatctgaacccaggcagggaggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaa

SEQ ID NO: 7179 - DNA, 983 bp, Homo sapiens
  ENST00000466258
gccatggaagctgctgattgttcttgaatttaaagtggagaataagggaccacaaattgcagggtttgagcattccatgtttttcttaaatgagcctgtctgcattttcaaaacgtgtgctttcaaaagagagctgtattttctgaatccagctgtgaatgtggagaccagccgtcctccaagggcatgcgagaacacaccgttgagatccaggctgcttctgctcggagagtggcttgctcggcggctccccagccactctttttctggaagggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttc

SEQ ID NO: 7180 - DNA, 1213 bp, Homo sapiens
  ENST00000435433
atggcagaggtgcccaaggaagcctgaggctgctctcccagtcatgacaagggcagagaggaccacaagcccatcccttccctgagaggcccttctgctgccactgtcccatgcccccgtgtcaaccccaggctgaaccccaggccctgggctggcccacagcccccagcctcacagttgccaccaccaacaaatcagagctgcccagcaagatcaggaagtgtggggaggcagcctccagctctggtgcagggctgcaggggcaggcaggctgtgaagtgcccaaggcactggcaccgtgggagagaggggggcagctgagcacccaagagtgctcctggcaagtgcatgactggctgtcggagttctgctgcagctatgtcacctggtgcagtggcccagccaccttccctgcctgctgcaggccccaaccattcccacagagcttcccttcgggcagtgccaccatccctgcacatgggctattataaacccttctacttccagtctactgtaccgggcctgacctggggacagctgctggcatcagcacccctgctccagttgcaggcctgggaccctgggctcctcatgtgtagccatcagtccaggccactccagtgatgaagggaggatctacagcccctttgagaagcccaagtgaccctcggtgacaggcaggcagagaatacattattccatccttgggccacagatttatgacagagaagatggatttctttattctttcctttgtgaaaacaacaattgtcttaagcattatgcacctcagtgggataaatgatatctctaagtttgctatgcattatataatggaagaaatagatgaagacagatcaatggaagacttgcagaaaataatggttgtggctcttatatacagattatttgtttgttttatgagataatttgcatttggggagcaggtggatctaccccagggaagttcctgctggggcttcgagttgtgacatgtgatatattagtagtgcttattgcaccaagtcaggttttagtgattccttcctcaactgttagcattacaatgtctgctatatgagctttgatcaaaaatttttgtatagcttcttttttccctgattgcatcacactgctgttttttccgcataattgaatagcctatgacattgtagcaggaaccattgtggtaaaaagaaatggggtcagatga

SEQ ID NO: 7181 - DNA, 1898 bp, Homo sapiens
  ENST00000539556
gtgggcggccccatcgcctagcaaccgggtggcagcgtcccttgagcccaggccacacagctgcacccagccctgcccggctcctcccaggcctgcaggacccctggggccctgtccttattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggctttgttcttattttctgattcttttttctttgtctttgttggattgtgttaattcaaagaccttgtcttcaagctctgaatttccttcttctacttgttcaattctgttgctgagactttccagagcattttgcatttctgtgagtgtatccaatgtttcctgaagttttgattgtttttctttatgctatctatttcttggtccgagcccactgctcccggcggtgtgaccttgggaaagtctcctagcctctctgtgccttagagtcctcgcctgcagagtggcttagaacagtaacctccgtgtagggctgtgctgagtatcagatgaacagatctatacgaagcacagaaaacccggcctgttgcgcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctca

SEQ ID NO: 7182 - DNA, 782 bp, Homo sapiens
  ENST00000618669
accccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatctcccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgcc

SEQ ID NO: 7183 - DNA, 1011 bp, Homo sapiens
  ENST00000629253
tattccccagcaccgggacagccaaagctctggtcacaatgaacatcgtcttctccagggacagccaggtgagggtgatggagaataccgtggccaacaccgagaagtactttgggcagttctgctcgctgctggccgcctacacgcgcaagacggcccggctgcgggacaaggcggaccagctggtcaagcagctcatcgactttgccaactccgagaaccccgagctgcgggccaccatgaggggcttcgctgaggacctggccaaagtgcaggattaccggcaggcccaggtcgagaggctggagaccaaggtggtcaaccccctgaagctctacggggcacagatcaagcagacacgggctgagatcaagaaattcaaacatgtccaaaatcatgagatcaaacaactggaaaaactggagaaactgaggcagaagtcaccctcggatcagcaaatgatcggccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatggcaggtttagtctctgtgagtgggtggttaaggggcagccagcccactgtgtgtgtgggcagggtgggcatctcatgcttccaggacattctctctaacgacgtagggtaagtgcaatcccaagccgtttaaaataatcccagactgcctggaggc

SEQ ID NO: 7184 - DNA, 539 bp, Homo sapiens
  ENST00000551451
gatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcag

SEQ ID NO: 7185 - DNA, 3616 bp, Homo sapiens
  ENST00000536681
ggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccacttttctatatttagtttttcttttctctctgagatgattcatttaaactcagtaaatatggaaagatgcatggcagaagctgaaatgagctcaagcagtactaaccttggaaccattctgggtacccaaaagaaaaatttaaaatcaagatgagtaaaaggagaatggtctcaatatcctcaaaaatgcagtaagagaagtaattccccactgaaaatgtctctctttctttctatgttataccctggagtcctggttgaggggtgggggaatcagaaaagtaggtttacatttaacatttttcttaactacattcacttcttaaaaaggaacaagaagtgtaaataagtatgtatagagtgagggattaagcatatttgcattggggactcgtgtattatgcttttaagtcaaaattaatattctcaaattcgaatttgatagctattatttctaaatctttttaatcctcaattttcctggtaaccttctttcaagagtctccttcttctaaaagttgccaaaccctttatatttaagctttttccactcaggactcaattagagtggtcaacagggagagggatggtcccatttgatctttgccactgagcaaaacaaaacttcaaatgaacttttaaactgtagctttagtcttctggtataaagtggggaagattacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaatta

SEQ ID NO: 7186 - DNA, 871 bp, Homo sapiens
  ENST00000549080
gagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacagtgtccttgcatgaggagtgcctctgcccggctgctgccccatctgggaagtgaggagcacctctgcccagctgccaccccatctgggatgtgaggagcgcctctgcccggctgcccaaccatctgggaagtgtggagcgcctctgcccagctgcccactgtctgggatgtgaggagtgcctctgcccagctgccgccccatctggcaagtgaggagtgcctttgccggcctgccaaccgcctgtgaagtgaggagcacctctgcctggccgccaaccatgtgggaagtgatgagggcctctgcccagctgctgccccatctggcatgtgaggagcacctcggactgactgcccaccatccaggaagtgagaagtgcctctgcccagctgcccactgtctgggaactgaggagcacctctgcccggccgctgccctgtctagtaagtgaagagtgtctctgcctggccgccaccccatctgggaagtgaggagcgtctctgccctgccgcccaactgactggtaagtgaggagtgcctctgcccggccgccaaccatctgggaagtaaggagcacctctgcctggctgccgcccagtctgggaagtgaggagcgcctctgtctggccgctgcctcatctgggaagtgaggagcacctctgcccggccaccaact

SEQ ID NO: 7187 - DNA, 558 bp, Homo sapiens
  ENST00000547411
cacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattccc

SEQ ID NO: 7188 - DNA, 567 bp, Homo sapiens
  ENST00000550541
tgtggctggagcgcttcccgtagcctcggggaaggagcaggatttagaggaccactagttggaccccatcctcgtgctggaggaacaggagttcatggcctccttgatgcccagcctcctacattctagatgtccagaggctccaggcagggccagcttcatggaaatacaaaactgcaaccgcacagggccttgcacttggaagggccctgcgtttggtaatgttctgctatcaccgtctgctggcttaataattttcaaagaggctctggatcttcattttgaactgggtcctacaaattatatcctgaccccaggctgacaaacttggtctaaaactaaccaaataacagtgtttgaacagcaatcccacatttacggtgagttctccagtacaaacctgaaatttatctgctgctcacttaggtgctcttggacatgtcattcagtcttcctacatttcagtttcctcattgacaaaataaagacaacagatgacaccttctactttctttattttcaaggttgtactatctctaagtaaaaagaggtaataattgtaaaaaa

SEQ ID NO: 7189 - DNA, 2095 bp, Homo sapiens
  ENST00000182377
cacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccca

SEQ ID NO: 7190 - DNA, 1787 bp, Homo sapiens
  ENST00000547116
aggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 7191 - DNA, 803 bp, Homo sapiens
  ENST00000552137
catgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagtttgaaagctactgatgcgaagattgctctgggcagttataaagggaaatgagttgtatgcagttattcatctgcaatgctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttccca

SEQ ID NO: 7192 - DNA, 425 bp, Homo sapiens
  ENST00000551193
ctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattatgtagtttcacttatttccttcaggctttttatcagcaagaagcaatgtctgattttgataccacccatttgctatgaaaatataagaaggcgtcatcttcaaagcaacactccagttgggcttcttcatcgtttagctgcatgatttcttctacgacatttgtaacagaca

SEQ ID NO: 7193 - DNA, 545 bp, Homo sapiens
  ENST00000547759
atatggctgggatcccaaaagcaaagcaacgcttaaaaaggtcctgcactccatactctaccctgtaacacagtttcatttagacttcaccacacctctatgaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgctttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 7194 - DNA, 4926 bp, Homo sapiens
  ENST00000595437
aagtcccgcgcagcccggggtggtgccggaagcccgtgcctgtggctccgggggaggggagggctcggtgggtccctgaagactgtcctccccgcgcgacgtcgcaggcgaagcagccccaggcaggacctcaaaaagcgacctgcagagtccgagcccctgaccgcccgcctgccgctcccggcttcgccgtgcacacgtctcccgctctccccgatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggcctggctccttttcccttattaggactccacacttaggacaagccaggcgcatcccatgtgctccagagaggaggccattgttattagtaaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaccaa

SEQ ID NO: 7195 - DNA, 433 bp, Homo sapiens
  ENST00000600648
gcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatggagtcttgctcttgttgcccaggctggagtgcaatggcgtgatctcagctcaccgcaacctccacctcccaggttcaagcgattctcctgtctcgacttcccagatattctctaagc

SEQ ID NO: 7196 - DNA, 10262 bp, Homo sapiens
  ENST00000319562
gcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaaccaactttgtctgtagtcttcattttctgtgtggggggggaggggggaaggggacactccagcaagggtttctaaagccccagtgttcagagtgacacagggagggcctgccccccactgttccctatgctccccccacctccaggcaggggcagagcaaacaaacagctccgggccacacagcagcatcaggctccctccagaagtcaccactcactcattcctggagacttggggacaaggcagtctcctcagctatttatttctgaatgattgattgattccaaactacttgctggacactggtggttctgacctgtgaccagcacctctgcttcctgtgtgccctcaagaaaatactagtgtgggtaacagtccatctgagtggagtttgagacacactacacatgagacacacaatgatgcagatactcgttttcttgagctttattggcccctgcatgatacagtccctgtgcttaagaacatgccctattaggtcactctgcctttgctgacacattttatagcagaaatacacaagctgtttttaaaggagggaaatataaaaaatgtttataaactgacagtgttttgccagaggaaaggtacaaaatgctacatacagaaccaaaccagccacttcacaagagcaatgcagggataaaactattggataaggaaggcagatgcacttccaagaaaatcagaacccagcaagaagtggccagtgcaccccaaaccacactggtgtccacctcattggcagcagccagccaggacacagctcaaaaacgcaggagctaccagccacccagtccacggccctcgtctcccagaggctgagtacctccccaggctgcaggctctgggcagctgagccaggagcagctcagggctggcactgagaggctactggtgacagtaaacccgtctcaaaggctgggcctggctacagaccagcagcagttgacgctgaggcaggttccagtggtagccctggtgcctgggctctctcttaatgcaggcctggaagtggcgacacaaaagccagcttccttggctaagatgcccttaaaaacattggggctgattttgtgcgtctacagaaagtaacagcccaggagagaatgtacacagaggcgagctttctaactccatcaaaccccacctcccccgacaggaaatgctgccagtcaactctaaaagaaccacttgttgctctacgggggaaggggctgagtatgatttgtctggcgactgcagagactccccgttcataccagtattcattagaacccagtccctcgagcggctcacccactgttactagcatgagactggcttcagtgctaaaaactgtgatgtcattgtccatttgtaaatctgaagaactctgtaaatcagaaaagctgctgtccgccctggctcacttaaaaatcaggtaacggcacaccctggggaacacagactcaatctgtgtgattcgcaaggacaaaactcatctttgacttatgccgccggcctcacgtaaggaaacagttccccacacagaatactccctggaaacacaaaatgaaatcttctccaattttattattcaacataacattcttgtatggagtaatgagtacaataagaattagcaactcagttctatttccccaaccaaaatatatcccttatacaaattaagagttcaacccaaatccacttctaataaaatacctcaattttagagcttaaaaaccagactgcactagcaaaccgacacaataacccactcaagcatctgtagctcagggctctgtcccctccctatagcttagaggccactagaccagcagatagctgagctacatccccaagctcacccactaacttccttgcttccaaaaatcctgtcttaactccacaagaactggcacacccacgggagatgtcaatcatcagcttcaacaaacataaaagaatgcttcatgtaccagtcaacagctgctgcacgaaccctcccactccagaaacccagagattttccccctcgccaagcaaggtcccacagcaaaccaagaaaaacagacacactggctgcctgcctagcaagcataggccccttccagagaagcaaaataactcttaaggtccccggcaaccgctacagcaatcgcacagatcagcaacctccaactgcatcatctcggtgagcaagtgcgcaagcagtccagggcgctgacctgggcactcggcagctccaggcctggggacttctccctggagtcttccaaagtgtctcatcacacacacacagccacgagtacacacgcacggccacacatacacagcaggtgccctgtcctctgaagagtcacatttcaaggagtatgcaaaataagcgtgttataaaatttatttgtgtaagcattcagacatttttaggtgggaaagatgatatgcagaatccactacaaggtgcaacagaaaatcgtattggaaaggacggtacatctggcgcagaccagcagtggcacgattccaaacaaatgtcagacgagagcgcttcatggggagaaactgaaaattataatttaaagcttcatgaggcaagatatgttccaatttaaaacactaagaaatagtaccatcgatgaaaaaggaaatcaacctctaggtgtaccaaaaggggcgtagggcaaacggggaaaatttgcatttgttgaggtacaaataggagtgttctgtaagagaggggcattaattattaatgacaaaccctgcaaatacaaaataaaacccaaatcactggtcacagaattcaaaatgtacatgtaataaaggcaaggcaatagactcaagttatggcctgtcgaatatttactccactgacgttatctacagaagcacttggccagtttgtacacagtgattccttatgcacgccgaaagggtttccgtaaaaatgacattatatacaaatctgtacacccatccaccagagcgattctccagctcccagagggagttatcaacttaaagcaggatacctgaggtttcatgtctttagttgccttatcataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctggacgggcgcctggcgctggggtggctcccagtggcgcacctcttcggtggagtcagcgaaggctctcgttgacttttaaaaaaggaggaggatgaagaaggaaaaaaggaaaaacaaaaccccaaatgccaaaggaatttcagtgggatgaagttcctccaccacttagagagtatctagggaaaaagagagagagagaagtcaacacatgtcatttctcatccctgtgcaaaaattcatatagtaaccaaaatcttagttttcataagaaattccaagtcatacaaaaataagtggagcaaatatcaatgtgtaagtctaattttaaaagaatgcatataaagactgagaagatcatgattcttacacaaaaactccagagcatgtcaccaaaaaccaagaatgggttcagcctccctggagagatgtgaataaaacgggaaatcatatcccttttacttacgatcaattgtcaaaaagtgaacattgatccatacatgatgacacagtaagattccagggatgcatatgcattcccgatgtgagggcaggaaacccattttggccataaaaatagtgatgcagtccaagaatctatttcctagaactgcttccgaaatatggtccaaagcaggaacaacgtgtctgcacaaagatgtctctcgggattttcgtaattacactaatttggaaacaactctgatgcccaacagtacagaatcagttaagtaaattatacaaactgaaataacagactaaaaatggtaattatctgtatttacatatatatattaaagcaatattaaaaatatgtacaagtttaaaagtacatacaaaattacagattgggcatcccttatctgaaatgcttctggctttggatctgggaatatccgcattatacttaccagtgtgcagccccaaatccgaaatctgacatgccccagagagcagttcctttgagccccatgctggcgctcaaaagtttcagattggggatttgggatattcagcctgtatatgtgcactatataagtatatttacatgaacaacttctgtatcctaaattaagtactatagaaattctaaaaaatcttctttgcactataaggtagataagagaattcagtaagtttatgacctggtatgacaacagaaggcaatgcacccaaagatgctgatgagatttgggctacagtggtgggatcatgggtaatttctgtgtcttccaaaaattctacaagattgtcttcagaagacaacaaagggtgagaacggggtcccctcatgaccacaattccctcaaccattttacaacagactccaaatcacaggtccaggagagatggctgaggatgtctttgaccaggcttatctcaaacgttccaatctagagctcctcttttcaggcatttgaaatacttggcatctctcccagagaacaaatggttacataaggtcctcccaaaagcacacattagccacggagcctaagactcaactatcaagaaatacaaatgactaaatcacgggatgagttgatgtcacacaaaagaatccaaacattaattccagctgagacagaaaggctctgaaaatgcttcagaggagaggcggctctcatttttcctacagccatccactgaaacaacatgtttggagcaaaactggcaggaagtctaagccatggccaccgtggttttggcagccatcggggtgaacgctcagtgggagcttcaggagcagggaaggaagaagtgggtaccacagccaagcctgcagagagatgataagcacctcaagaggcagctcatctgaggacagaggaggaaagagggcactcctcatcacagacaaaggaaagagagcaccaacttggcttcccccatgcatcactgcaaagtaaagttttaaacacaacacagacatcaggtagctacagacccgcccgagggtaaatagggtcaaccccagccacgatgcccagtgagcacgtaaaatgtgctgcgtctgaatggagatgtgctaagtgtaaaacacacaccaactccaaagacggtccctccaaaaatgtaaaataccttattgatgattgttgttattaatgttgaaataatactttggatctggcaggttaaaaaa

SEQ ID NO: 7197 - DNA, 13532 bp, Homo sapiens
  ENST00000596580
cgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggtccagcatcccgggctgccagaggcagcagtacttccattcctttcattgactgcagtgacgtagatagcgaatacgaccttcttagagaacaagcgtcccgatcccggtcccgatcccggtcccggtcccaaacaaatgacaattatgagggtgatctgaccagcggtgtctatctgctgtccagggaggaggggcgaagagaggctgggcgtagggcttccccgcactctgcgaagtcctcccggcctccttccggagaattccttgatgacgattcagcagacatcacctttgatatgagcgggagccctcgactcccaaggcatagctctctcatagatgaaatgttcaagggctcggctggtcacagccccctggccaccccattgtctcccagcagcagcagttcaagtccaaatatgagttgggacagaactgggtctcaaggctatgtttcggaaaatggacatgaccatagagaggggagtatgggagaagacactctcccggaccagggtcctccttatgaacgctggtcccccacctcgccaaggccatacatgcggaatcttcctggtagatgtaataagtcagagacagatccactcatccttagccaggtagcatttaccccggaggccatggatgggcttggtggccgtgggaagtgggggcaagccagcgcagctgctcccgagggtagaagcctggctaatggcacaccccccatgggtgcagcctctaaggtccctgctgtgcagtcggtgtgtgccagaggcatggcggggcagctggcacccctgcaagtgaccgagggctccaccagcagtgggactgagtccagtgagtcagactctgagatgctgatccccgggagtcagcccctcatatttggtaaccccgcagtgctgcgttccccgtccctgctgagaagccgggggtccttgggtggcctgcgtttgagtgaggaacaggaggaggatgagtgaggaacaggaggaggatgagtgaggaggccaggagccaagtcttcagcccgagcaacctggggtcacgagaccagggtttccctaaagatcatctgttctagtgactcattcatttgtagtctacatttgttagaggagattttggacaggcacatgtttgaaagagtctgcctgacttctaaaatcgttaagaaaaacaaaacttcacataagtggcttgctttccagaaaaggtgggcaagataaacagcaagtcctaatgacaagttctcaggagcttgtttattttgctggttgaaggctaggaagaaacactttattatgaatccgatcatgtgtatagtgtgttatatttatatggcaattttctgtgtatgttcaattatgcagctcaccctcctgttggttgagagtttgaactgaagcatccttgagattacagaaaagggtttcccattctccccttctttaaaaggagggctgctttgtccatgcctcatgaagtgaggaattggcactattcaaggccaaatgtaaattgatagctagttgagattatgttggtgaaatctttcgtcaagaataatgaatattttaatgggaagaatttggggttatttctgcttcccaggcttcctgtgaaatactagaaaagttgtcaaatcttcatgaattgtgatctactagggattgctggtttggtttaggtttgcattggtggatcatattgttatgttttaagaagtacaattctgcctctcagaatctcttggtgaaactgaaatcctattgagtgtggatgcagggaagagcaacaccttgaaataggcactgttgtcaccagtaggtcaacaaactaaatgcctgcctttgaattgtgtacagcgcagagaaggactgttttccagcatggttgctcttggttggtgtacagacacagtcttaccattcacactctggtgaacagtgtcctctgttgggaatagtgatacttggatgtttctctgagccagaaaaaagaaaatgtaaggagagagagattgacttctttttaaatcttgcccaccagtgtcactgcctttcacccagcattcctgcattttagattaaagagcctggttttcacttgaagtttctctgccttagctgcacgttgcaattttctgagatattttaaaaattagtgatgccgggaccctgaccctagggattttgatctcattggtcttgagtgctccttgggcttcccagctgtttgtactgggcagccagggtcacttcttacccaggctgtctcgaatctagtggaatacagtaaaagtgttagctaaatttttggcttgcttgcagagtaagaaaaacatcacaaacaaactgctttttcttgatgcctgtgatttgtacttttcagccttaggtacttttttttttgaaaaaaaaaaaaaaaaaaagataaattgtagaataaaatttttagatcctaagtaactacaaaattattgaaaagagtcctaacaaggatagctccctgatgtgccaccataccagggcctcactgggctcatcacgcgacccgatcacaagggaagcaccaggcgtgcttaggacactgagtagaatttggcagcagcatagaaaatggaggaggatcggctcgtctcattgacaaatgatatctgtccacatgaatgtccagaagtcggttttaaagagtctgaacacttaatccatttttatacagactttttttgttttgttttcctaatcatttgattcagtgcctgattgaatcaagctgattgttggatcgtttgagagttgttcattgaagtagtctatttacgccttgctttgaatttatatatttaaccagaatcacagaatttttaaactggaagggacctcagaggttcttctgggcaaaccttcatttcttctgaaaaagttaagtgactttgcataactaatacagctattgcatgacaaagctgaaactgtaacctcgtctctaggcttcacttttttaatctctgtgatatcttggtgcaataggagctttttgattcaatattttaattttggagagtcatatgaattaataattcaaatcggatgtggagactagtgatcaagtagacttaggcaattacaggccataataggtgggaagaactacttctttttatatggtgagggttttgcagttataacacatttttgcataatctgttcagacataggaaaaatgtcaatttgctatgagtgttcagtgaagtgtgagttaaacagagccaagtgtggaatcctgtggtttatctgtgaaagtggtttgttcaaatgaattttctttttccctctaattatacagcagtctggtaatgaaatacgattgagcactaggtatgaacttacacagcgtatgacaggaatcgtcaaatgtaagcatccccgagcaaaacacgcttcaatcattattttgttttgctttttcctacagcagtgatttttatctaagtattttaagagcagttgatcaatggcagtatactcagttgtgtattgatgagatttttcactttaagagttgctcatagagtttttccctcactggctttgtaccaggcaagcaacttaatttctgcttcttggccagtattcacaaaagcagcaatcctggtgtaattaatggtgcttacagtttgtttaaaggctgtttatcatacatcctgatgtgctgcgaatagtcactacttgcctcaagaggagcttgtcctatgctaataaagattctataacattggccaaagggtccgtttatacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctccttgtgctaatatcttttgttggatattatttcaaaatatgtgaattttagacccttttgtggttgcctttgctgccgcttgttaagggcaaaataaaaacgcaagaaattcttttagcatgaagaaatacatttaatgagctccagaactcaaaataaatggcttcagctccttgaacagtcatctgtatgccattgacaatattttattagataggcgtttaattagaggaagtctgtgggccagattcttccctgcatgtgtgattcatatttggaaatttctgatttatctccccccaattgtgccatgtggcctgcacttaaaatgtaagtaattctgattttattctcaagaacttatttgaagattcaagccaagcaatgctgaaaaaagctaggcctgcaaaactaaaacatagcacgagcctctcaaaatttccaccaaatatacaaaatccagtctgctctgaatgtgcatcagaaactcaactttggttattagccctggaatttggtgccaaaaacaaaaatttggttttgttgtcaagcaatttctaaaggaagaaacaatgtaaatattaatctgtcattttaaatgttgttgaaactgccatgagtgtgcacacagctctctgtttcatacctgtaatcagtattcgcatgctttcagtccactgtttctacttaaagcattattccgtatttcagcacagaatgactttggtgaaactgtagctgttagtgagtaattgcgttacaggcagacccagtcttaaattaacaaatctgggttcccttaactatcaggtttatgttggttttatttgcttctatctggatcccttctctttgcctgggaccttattctgattagctagatttttaagagcttttaaagttacattccccagaaagactttttttctctggactttctcttttatggtctgtaaacatttctcctctgatggtcatggacttagttctaagactggccttcctctagtgtgatggtatgagtctattctattgctgctaaattttacaaattgaactgcagaagagtctttctaggtaatccctgtaacagagcaagtttctttgaaccctagccatgtatgtgtagtgttccattattggaacgctaagcatgtgggagttatttatatcttactgctcacggtcatcatcaaggtctgattacaaaaattcaaaaaattacaacctcaggcataaatttaaagaggtggccatttaaaaataatccgttgctaccatttccacttaaaatggtagctctctgatgagttttatattggctctctgttagccaagcccgtaagagcatatggagagaaaggtacgattgaatgaacttctgtgagcggcataaagacatttactctgacaacattaaagaatttactggtactgttttttttccttgttagtttaattccatctgtttctgtttaattgagtgaaacttaataaaaatggtgtctctagtgagcacatgtacacacctctcccagttgttgggatttaaaatgaagctgtgacttttaggccaaaattagcgtgacacttaatataacagttttctttctattaaaaaataatgacaaaacacacacacacacacacacacaatctgtatgatgatttggcctggagttgtagacatcacagatcaaaagtggcctggtgctagctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactccaaaaaaaaaaaaaaagatgaaacctcaagcaggaggaacttttttatttaacccctagtgaaagcaattaaacgtcttggtagatgctagggaagaattagaaaatcttcttttcctgaaagctttaaacattgaatagactctgatttattcaggatcatttcggtgtagattggccactcgacacagacatcacagcatggtagcctcgaaaccaagccttcagcatcttctcggcgcccggtgttggagtgttacttggagtggaggcagtgcatttgcatcttcatgtagtctccagatcaggttactctgatttgtcttggagtggctttctgtttgaaagtagggaagattaaaaatcaacttgccacgggatatctgatctccatgagtagttgaaagccagtctaaaaggttaactctacagggccggcgccgccagtgcggtcatggaaaatcgtgctgtgagatactggagtgtgctgctggggccaggtgcagcaattgcagaatgttgaggagtgaggagtagttagaaatcactgcaacatggaaaagcacacagaccaaggacgctaaggagggagcgaggactaccgggcaggtgtgcgtgtgtggagtaaaatgcatcggacagtgattgactccacttttgagtgagatgtggaggcggtagtggtgtgggggttgtgagggagtgagtctgctttattatgaatcaggattgatagctggccttaaagtgggaaatgatagaagggtcacttaggagcctgcagtggcatggtgaccagtctgttattactcatagatgaccttttctggctcttgaaaccaagctaacgactcctttttcttctgggcctcaaagtttctttgtaggaagtaaagcatttgtcactttccctgcagtgatttattgaaagactgaagataggtcttccttagttaaggacgcacactggctgctcgctccagaagcaccaagaatggctgatggataaatcccttacccatactcctgtttctgcctcctaaggttgctgtgaaaacctaactaaccaaacctcaccagcttggcctatattattaatcaaattcccttctgttctctctgtgtgtatatttaatactgtagataatatgttttatttaaaatttctaatacaccaaattaatttgaaatagaaaaggctggggacttcattctcatttttgtcatttgtttaatcagtttgggaaaacattttccgttgttccattgtatgcagtgtcttgtcagcatgtacctatctaggagaaaacgctttgttttcagcgttctgtctttaccctcaaagcatggtgtagcttctgttcttacactgttggagcactgtctgatgtctttttttttttttttaacactgctgaataccaatttgtacttggaatacctctttcctctagaatacagtgatcctattccccaaagtgcaagctttcatgtggaagcatcctaagtgatcgtcctgggtgatgccatatttcactaaagtgggaaaagaagaggtgaactttgctcttccaacaaggcttgcactttatactttgggcagtgcatgggagaaggggggcccttagaggtgagcaggatcactgtagctagaggagaggtctcactgaaacagaacgcatctgtgactgtagcttgcatggagagcctagacagccaaccatggatttgcctttatgttttgaatggaaacatctatttcaattgggatagaaacctttacctatgtcatatctgtaagagaatttagcttatagatatgtagatacgtgtgtgtgttgctgggtggggaagtgggtgggaatgtagaaaaggcctcacctgacttggtcccagttggcttctgatggccaaggagctgtttttcattttggtgggcacccaacatgtaggttctcacagatgctgtctggtttcttcttctctccatggcggaacaatgaagtacgtcaataaagcatggactcataccactgggaagaatgctggcttctccagtaacaatgagcttggtggttctttgagcatggaaggccaagctcatgtcacagtgtatgcacggtattaatatatctcttgttgatctaaactgaaggggcttttacttgtcctaacaggtatcatgctgtaaaaactgtccattgtaactgttctttcccactgatggctgaagctttgtcctgagtacaagatggtatttttcattggtacgaagcaccatgttcccaacccaaacactgcctccaccaccaccaccaccaccatcaccaccaccactgctactaccaacatcaccaccaccatcaccaccaccgtgttcaaacaaagcagcattctcctgtgtcttttcctcataagtaagaacaaggtagcacattcatttttccattagtgcatttcaattcttttcctgcaagttgcattgctattgcttttctgaattgcttgatgatgaactgtgaagctgatgcttagctgcttgtgaaacttttcttaaaggaactgggtctaagaagcacacatacattaccctcaacaacctcaggtatcaagaagaggaccacactgctaacatgggtaatcctataacctggcttttcttgtggaactttgtaatttctataaaataccgccagctttgcgtattccactgagccccaacttagatatcagacgctagtgagtcctgcctattcaggaagctacgtattattcagcataatactgcccttttttttgataactggctttcaaatgggataatctcaagagaggtttcattgtatcctcttagagcgtatggatttaaatagagcctttcaaaaaaatagatgaaaacctacatctctaatatatttcctacttgggccttttgagcatattctgggcacatagagagaaaatctcctatgttttagaacagaataaaagaagacaaattatggtagataagtggcacccagaagattgcaaaataaataattttatgtgggggaatattgaagaaaaagcatagaaacttttttataattgcactttaaaattttggaaaagaaaaattgagaatgcaatcagtagtctcatttttgtcagtattctgtcagatattagctattcaataagcatatcttggattactatttttttagttgtcagtttttctagtttccccctttataggaaaaaataatacctatgtggttaaaaactgagacccatttaaaaaacaggacaggtacagttaagtactagaaatgccgtttttatcacttgaaaaatagattagaaatgtttttcttttcccagaattgtgtgagtttgttttgaagccttgaataccggtacatggttaacaggcagcttgtgcccaatcccaaagcgggaagaaaggcctggctttggctcactgatgataaagtctcctcccactgcctttcagcagctctgccgaagagctgatcaagatgctgcaaacccagcttccccagaccggccaagagggaagaatgatgagcgtgttttaaattacaaagagagagcagcgcaggcagtttctggtctgggtgataaattgaaatccataaatatagcagtgctaatttgaagttccgtaattgtttgtgccatgagaatgtgtacatttgaaaggattttataaagcaattactagaaatgcctcccttgagagctgtatgactggaggtgttttcagtctgaggggggcagcataaacccaaacctcttctagatgaatggcagggtggcgggaggggtcatgaaatcatggggaagaggtgaaggatttgagagctactaacctgacatctaactgaatgcctaagaaattgcagggcaatttcaggaaataggaaaaataattttgaaaacattcaaagcctccagactttcggtgtgtgactgatcttttttctaatctctttaaacttctttccacctattgccttaatagcaggtgcttcctcttagggtccccccaaattatttacctcgagttccctaatgaaattactttgcattaatttgtcataaagggagaagtgctagaaataccgaggcattgataatttcatggagtagcaatgaatgtcagtcacagtttcctctccccgttgcccggggctgtgccttcaaagcaggtgacagactgcaaggtgtaaacaagctttataatgccatataaatcaaaccgggctcattttacctaacaacagaaccatgtttgtttgcttttttgtaaaatggactacttcagtgaaaaattgattccacgtagttctaataactctgtgaccttggacattggctttttatagacacagctcttcccacctgctggtatggacaccagtttgtacagactgttgtcacacaccctggctcaaagtcaaaagagaattttaattactcatcaagctgccaaattctactaattgcccccttgtcagcatatttcattaattgctgaaaggtaaatgagttacatattttgtttggaccacgtcacctgtacattttcaaagcctcggattgtttatcttgcaaagagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctataagcaaagctggagtagcgtcttgggaaaaggccaactgaccaccctaattttgtcgttccaagtctgcagagcgcacatattaagtagttgttactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagactgccagaatttctctcttctaattcctacttgtagtgataacatttttctttttgtgatttttttttttttaaataatagtgtagtaccttgaaacaactgcagttctaactcattgtcaccatttctgtttgacacgttccacttcctttgcaattattgtatttagttgtgcactagtgtcaataaaattgacatttgtgaagcaa

SEQ ID NO: 7198 - DNA, 1021 bp, Homo sapiens
  ENST00000376581
cggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccaatggtgtcctcatcctccttcctcaaagccaccggctcctcctggacgggttgggtactgagatgctccatgaagcccaagcaccattcacatctaattgagaagtttggagaggacagaattctcactcatcttacaggctctatttcttacacaaactgggctggaagtagaagcttagcggtcacagtcactgaagagcttcttaatcttttttgagtcaggacttgaagtcctgtttcattatttcattcaaagaaattgattggcaatggccagagttaaattcaaaggtgacattaacacatttcagtgcccaataagtgatttttctgctgggtaggagtagatacagatgtgatctcagatacgtgaagctgcatacagaggggcccatccactcctaaacgggtctccaggaggcttggtttgatctactagatttggtgcctcttaaagggaagcaatacagcttttctgctgtgggttgtttgccactaggggaagattcatttctattccagccataaattagaccaaagagagggatttggtttattgctagtgcagaagttaaaaaccatcttcctttcctgagtggtctcttaattagattctttagtttttaaatgttaactggaattgctgaagtttaattcctgaaagggtttagtttttaaaaggagtacctcatttaccatattactgtgttctgagaaatctacagtaatttttgtgtaacttttttattcaaagaatggattgttaattgtaaagccatttagaaaggcgaataaagtcagatctactttaa

SEQ ID NO: 7199 - DNA, 747 bp, Homo sapiens
  ENST00000598389
attccaggccatagcgaaccggtggtgctcatcctaaaacacaggcgcttgaaatgcgtatttaaaagcaacacacgcgcagtgcagaaaacaaaaacagatacaagcaaaaaatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacat

SEQ ID NO: 7200 - DNA, 457 bp, Homo sapiens
  ENST00000601361
ggaatctttggaaagaactggcttttgttcagcccttagggaagaaagcctgtggcctttagcaagcaaggatgggggtgtaaccaggctcatcagacctcccatcccctcacagccacagacccagctttaagtttcccagacggaagattattcttactgcagatcttagcaacctcagcacatgactctttttctttcctcattaagtcaagaacctttggccttttcacttaaaagaagcactctaaggcttcgctttgacataccccagttgccagcatcactactgtttgggaccattaggaagtaaattcagggagacttgaacacaagcactgcttatctcgaaagctgatctgctcaccgaggtggcccttgagcacggacagcctggatctgctggcaaagagctcctgggaaggtgctgctggatgcagtttgcaaccacctcaac

SEQ ID NO: 7201 - DNA, 778 bp, Homo sapiens
  ENST00000595817
agggaagaaagcctgtggcctttagcaagcaaggatgggggtgtaaccaggctcatcagacctcccatcccctcacagccacagacccagctttaaggttactctggggtccccttggccaagaggagggtctgttctgtgggttgagagccttaggattttatttttctttcttcttgttcatgccttcaacaagtataaagccctttccatcttaactaagcacttatcacacactgtggctgtaacttctgcagcttgagccgcctgcggggtattgtagaaacgctgcgctgcctatcacagcttgtgatgtgacacgttcattctgcaagtttaaacttcgcctagcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttc

SEQ ID NO: 7202 - DNA, 558 bp, Homo sapiens
  ENST00000427404
cagggagacttgaacacaagcactgcttatctcgaaagctgatctgctcaccgaggtggcccttgagcacggacagcctggatctgctggatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaa

SEQ ID NO: 7203 - DNA, 806 bp, Homo sapiens
  ENST00000601656
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagacagcatctctttgagcaacaatttcttgaaataaaaaaatatattcttggccaggtgtggtggctcacgcctgtaatcccagcactttgggaggccaaggcggatggatcacttgaggtcaggagttcaagaccagcctgatcaacatggcgaaaccccatctctactaaaaatacaaaaattagccgaccgtgctggcgtgcacctgtaatcccagctacttgggaggttgagacaggagaatcacttggacctgggaggcagaggttgcagtgagccgagatggtaccactgcactccatcctgggcaacagagcaagactctgtctcaaatatatatatattttccctagttggctttagactcttgaccccagcttatagttgtttttgttaaagactgtattattatggtctctccat

SEQ ID NO: 7204 - DNA, 576 bp, Homo sapiens
  ENST00000602015
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaatctttatgagcatctactatgcatcatgctgttctcgtgaacaaaacaagatccatatcctgagggagtgtgccttccagcagagaaagacggcagtgtgtaaggagcgttagaagaagatgttgtcttttgtgtgtagaaagtggtatgtaaaagtgaaaaataaaaagaaatagagcagaatcaggga

SEQ ID NO: 7205 - DNA, 786 bp, Homo sapiens
  ENST00000598698
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcttttcaaaggagaataaataccaagtatctggttagaactctgacctctttgcagaacacaaagctggagctgaagctcacccccacccccactcactcccgtggttaacagaatattaaacctgaaaagtacattttaaaaaaagaatgaaaagtaaaaatgtttgggaagttttctggaaactaaagagctaagaattcttaaaggatccggaaagctgtgttttcatacttcagtttgatgcatggattttcagtttaaaagccttttgcataaaaacattaaagtctccttctaagggatcggttcttggggaaaagctgtgcttcagagacaaggttgaagaacttcgcctgcatatgatggaagatgacaatgggaaccacaggtgtcattggtggc

SEQ ID NO: 7206 - DNA, 641 bp, Homo sapiens
  ENST00000599151
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaatctttatgagcatctactatgcatcatgctgttctcgtgaacaaaacaagatccatatcctgagggagtgtgccttccagcagagaaagacggcagtgtgtaaggagcgttagaagaagatgttgtcttttgtgtgtagaaagtgatcggttcttggggaaaagctgtgcttcagagacaaggttgaagaacttcgcctgcatatgatggaagatgacaatgggaaccacaggtgtcattggtggctttgtttta

SEQ ID NO: 7207 - DNA, 583 bp, Homo sapiens
  ENST00000601762
ccttgagcacggacagcctggatctgctggccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgt

SEQ ID NO: 7208 - DNA, 709 bp, Homo sapiens
  ENST00000595366
ccttgagcacggacagcctggatctgctggggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaa

SEQ ID NO: 7209 - DNA, 781 bp, Homo sapiens
  ENST00000596545
ccttgagcacggacagcctggatctgctggcctggagtcggggactctgaaacctaatctgaagtgtgtttaacgagggttctgaacgctgggacttattgctgaggggaacaaggagacagtgtgtcctcaggggcagtgtggccgcccctagagccacagcaagcaggaagaatcgcagcatttgtggtcagaaccgatgggcaggcctaaacatttagctactttgccccagaatgaaagccttgttccagctccccagggtttggatttaaagttttagttcctgtcggtggtcgcagtttcctgacgagggtgccatccagtctgctgttcagcttttgagtcatttaatttttcttcttccaacttctcctcctccaccttctcctcctccacatcatcatcatcatcccaaatacccattagagctcgcctagtctggatgccgttctaagggcatggtgtatactaagtcgcttaatccttacggtgacccagtgaagtggttcaatctttacgtccattttatgtaagaggaaactgaggcacaagaagtagcttgcctccagtgagtgtgactttgggcactccgttgtcctccagcctggaaagtcccagtagatacagcacagctgaggtgcaggtgtgcaggtatatcaatcccttctgcccacagggtaaagccctagagcattgcatctggtctcaagtgtccagggctcaagtgtccagctttacacagatgttactgctgatgtctggaaagtgaaaaaggtag

SEQ ID NO: 7210 - DNA, 784 bp, Homo sapiens
  ENST00000602272
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaatctttatgagcatctactatgcatcatgctgttctcgtgaacaaaacaagatccatatcctgagggagtgtgccttccagcagagaaagacggcagtgtgtaaggagcgttagaagaagatgttgtcttttgtgtgtagaaagtggttgcatcatcctccagtgtgtggaatcgtcctcctcatactgtttatccattcattcagcagtggacacctgggttgcttctagcttttggctattgtgaataattcttctgtgaacgtggatttacaaaactctgctttcagttattttcgttgtatactcagaagtgagatcgctgtatcctaggataagactatttttgtaattttgagaaactgctgtactgtttttccatagtggctgcaccatttt

SEQ ID NO: 7211 - DNA, 756 bp, Homo sapiens
  ENST00000598346
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctaggttgcatcatcctccagtgtgtggaatcgtcctcctcatactgtttatccattcattcagcagtggacacctgggttgcttctagcttttggctattgtgaataattcttctgtgaacgtggatttacaaaactctgctttcagttattttcgttgtatactcagaagtgagatcgctgtatcctaggataagactatttttgtaattttgagaaactgctgtactgtttttccatagtggctgcaccattttgcattctgggatgtgacgtggagcagaattaccttcagagtgaagttcaaaaactcactgggaataagtacagagaaatgatgctgcaagctgatgaaataaatttactataggaacaaaa

SEQ ID NO: 7212 - DNA, 518 bp, Homo sapiens
  ENST00000602171
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagtggctgcaccattttgcattctgggatgtgacgtggagcagaattaccttcagagtgaagttcaaaaactcactgggaataagtacagagaaatgatgctgcaagctgatgaaataaatttactataggaacaaaa

SEQ ID NO: 7213 - DNA, 856 bp, Homo sapiens
  ENST00000596613
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaatctttatgagcatctactatgcatcatgctgttctcgtgaacaaaacaagatccatatcctgagggagtgtgccttccagcagagaaagacggcagtgtgtaaggagcgttagaagaagatgttgtcttttgtgtgtagaaagtgcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaat

SEQ ID NO: 7214 - DNA, 749 bp, Homo sapiens
  ENST00000601853
ccttgagcacggacagcctggatctgctggcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaataaggacaagctgatgaagagaagaatcagctactagttggccctgatgtaaagagcacacgtgggcagcatggaggcgaggcagggctgcgtttgtgcaggtcgtgtggtccttgctctgagggttccgcgtgaaatttaaggagcagcctatttccacatttcaaagaggagaaatgtggggagcgaatgagtttcatagtcatgtcactatggcgtgacaggagggcaagaaaagacaagcgacccagaagaaaagagaattagacgtctccaccctgatgccaaaggaaaaactggaccattcggctctctttatatggaatgatgggaaagagtgtgttctaagattcataggaattaagaagcccaaacataaagctcacaagacattt

SEQ ID NO: 7215 - DNA, 810 bp, Homo sapiens
  ENST00000600032
ccttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttca

SEQ ID NO: 7216 - DNA, 799 bp, Homo sapiens
  ENST00000596467
ccttgagcacggacagcctggatctgctggcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcaggtgagagccttgagaacacggcctggttcccttggtgacagagagagaagagctggcccttcaactctgattcatattcagtgggctaagacctctgatggttatttttcggcgaacaaagaaaaattaacctcatctcaggctttctgtttcccaggccctcagctcccagattctattt

SEQ ID NO: 7217 - DNA, 616 bp, Homo sapiens
  ENST00000595380
ccttgagcacggacagcctggatctgctggcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaagctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaat

SEQ ID NO: 7218 - DNA, 612 bp, Homo sapiens
  ENST00000601133
ttgagcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaagagctcctgggaaggtgctgctggatgcagtttgcaaccacctcaacctcgtggaaggtgactattttggcctcgagtttcctgatcacaaaaagatcacggtaccgggcagggctgacttctttcaagttgttaccaggcttgacttttatgatttcactccattcttacactattgtttaggaatgtattcaactgcaaaataaaacccaccgttgatgacttaaa

SEQ ID NO: 7219 - DNA, 871 bp, Homo sapiens
  ENST00000593990
agcacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagcaaatctttatgagcatctactatgcatcatgctgttctcgtgaacaaaacaagatccatatcctgagggagtgtgccttccagcagagaaagacggcagtgtatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctg

SEQ ID NO: 7220 - DNA, 767 bp, Homo sapiens
  ENST00000594657
cacggacagcctggatctgctgggtaaagggagaagttatgtccagggtgggacagagaggacggcgagagatttcctcactactcagaacagcgggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccagcctggagtcggggactctgaaacctaatctgaagtgtgtttaacgagggttctgaacgctgggacttattgctgaggggaacaaggagacagtgtgtcctcaggggcagtgtggccgcccctagagccacagcaagcaggaagaatcgcagcatttgtggtcagaaccga

SEQ ID NO: 7221 - DNA, 748 bp, Homo sapiens
  ENST00000457431
ggaaattcaaaacttagggattatttctgaaattttccatttaaaattttctatttaaaattgacgaagggtaactgaaaccagagaaagcaagactgacgataagggaggggcctcctgtactccaagagcactgaatctggaaaaactcaacacatcgatggagtcatatatttaattttttcttaaaagccgcctgcggggtattgtagaaacgctgcgctgcctatcacagcttgtgatgtgacacgttcattctgcaagtttaaacttcgcctagatcggttcttggggaaaagctgtgcttcagagacaaggttgaagaacttcgcctgcatatgatggaagatgacaatgggaaccacaggtgtcattggtggctttgttttacaaagtcttcacctttctgctgagtcacgggactaagttcaacacaatttctactttccgccttcctttggaataatagttttggaagccaagtattagtatatgataccaggtgtgttttctaaagattcaggttcagtgggctgaatgcactttcatgacttcattagaccactgagcccaaggagaaaagtgccaatcttactagacatgaggaaaaagacacatcttttgctcttgctggaagtggtgtcctactttctacaagcagtcgtcatctggtttatacttgccttgttcagtttttgtgtgatattttattctctgcctaatagatattaaagtatcaagctgtcaa

SEQ ID NO: 7222 - DNA, 555 bp, Homo sapiens
  ENST00000599040
aggagacctgcctgagccccacagctacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaag

SEQ ID NO: 7223 - DNA, 867 bp, Homo sapiens
  ENST00000602263
ggtggaccccgaataagttgctgtgcataagttaaccatgcagctcttggcagctggtgtggggactcaaacccaggattagggactggaatggagcagctcattgctccctacattaaccgacctgggaaatgcttgtctgaccctgtgtgtcggaaacagggcacattgctgtagcaaagtggtgaagataagattggtgatcagtgttccactctgctctcctgacccatttcctctggataagcatgcctggagaagaggagagcttggcagggaagaatgggggttccacgcagtcacatgtgactcctgacattcctgcagcaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggc

SEQ ID NO: 7224 - DNA, 667 bp, Homo sapiens
  ENST00000601009
gtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatttcctggggtggcctggagcccggagccgtgggcgacttcacagagaaacgacgtaagagccaacattgacacgaagtatgaggaagaggatgaacgttgcgtttcagtgattttaaggaggcaggaagggactttcagtatctgggttttgtttttcaaggaaatgtaagccaaataaacataatttgtatatgaaatctgtcaaaaaa

SEQ ID NO: 7225 - DNA, 764 bp, Homo sapiens
  ENST00000593548
atcaaaacagctgggctctggtcattagactattttttatgaagcttgttatacagtatatgtgatacaaagaaaaaggtgtgctgtctcagaggtgtaacaattggtgtacattgaccttgaactagtgttgttaaggcgcaagtctgattttaaagctctatcctttaactttccacattccagcagtattgaggactgtcttgaggttatgtgagaatcatatttctcacagataaaaacgtgtaagactttgcaatctgatctgttatttctgacaagactacgaaaagtttaataaactcataatttttttaagcattagattatctacctttgcacccactgacgttcctcttttctctgcatgataaagcatttgcgttttgcactagtcattgctaatatataagagtttcactttgatgtttataaagtcctgaagttttagggctttttaggaggtcatacggttgtcacccacatgtgtagaatttactgccaagaacctccccaggcggatggggagaaaagaaaaaccgggagcagctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggc

SEQ ID NO: 7226 - DNA, 604 bp, Homo sapiens
  ENST00000490389
ttttgtatttttggtagagacgaggtttcgccatgttgcccaggctgatctcgaactcctgacctcaagtgatccacccgtcctggactcccaaagtgctgagattacaggcatgagctactgtgcctgaccttgaagcttctttctgactgatagagatgaggaggggagaaaactgtcttctcacatcaccacaattgataaatgtatcctggcatcccgtctctgagatctggcccttctgatgttccccaccaactgggctcaccttatgttgtctgctagcttctgtttggctcactggggaatattgacaaactgggaagtgtcattcctacgtgacctgtttttctttctgtttctttttagctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgt

SEQ ID NO: 7227 - DNA, 566 bp, Homo sapiens
  ENST00000600190
tagttaattgaacattttttctgtatattcaaggaaaatatcaagagactgagtggacccaaaaatacagagtctgtcaggattgcttttagtcctggctagccaagcaaccctgcatctctcccagttagggaaggaggggaagtgaagccctgaagcatcatttgtgtgtttaaatgagaatgccttggtatttctccccttccctgttgtggtctctgtttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggagga

SEQ ID NO: 7228 - DNA, 602 bp, Homo sapiens
  ENST00000457029
gttcaaacaaagcagcattctcctgtgtcttttcctcataagtaagaacaaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaaggctggagtgcaatggcgcgatctcggctcactgcagcctccgcctcccaggttcaagcc

SEQ ID NO: 7229 - DNA, 764 bp, Homo sapiens
  ENST00000423063
cacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaagggtaagcagcagtggcctcactatgcactgcgcggggagcagaaaggaggcatcggagggacttacatttgaaccttttgaagagagacccttgcaaagcaaaatgtcctctttccatccacctgggagacaactggaaaaacacaacagtgtcgttagttcagaatcattgtgttcggaggagataaagcaatcctctgacctcatattctgctttttctccttacggggtgattcgcttctttaccttttcccctaccatatcccacagaagatttgagattgcttattttattttttttaaatgtacataaatgaaaatggaaaattaaaaaaaaaattaggtaaatagtaataaagccagaaaggtagtgcattaaattatgctagaaattc

SEQ ID NO: 7230 - DNA, 744 bp, Homo sapiens
  ENST00000596256
ggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaa

SEQ ID NO: 7231 - DNA, 3841 bp, Homo sapiens
  ENST00000597777
tgttacctaccgctcaacaccttcctcctgcggccactgcaccggctcatgcactacaagcaggtcctggagcggctgtgcaaacaccacccgccgagccacgccgacttcagggactgccgaggtgagtgctgggagcctgcgccacctggtgcccatgccacagttcaggccgggtgctcccagactgagcccagccagggaggggctccccggggagagaggtcagctgatgctgggtcccaggttttcatcagggtgggcgccggtttttattcctgctctggtgtttggttacatcttgattttttttttttttttttgagactgagtctcactctgtcgcccaggctggagtgcaatggtgcgatctcggctcactgcaacctccacctcccgggttcaagcgattctcctgcctcagcctctggagcagctaggattacaggcgcccgccaccacgcccggctaatttttgtatttttagtagagacggggtttcaccgtgttggtcaggctggtctcgaactcctgaccttgtgatccgcccgccttggcctcccaaagtgctgggattacaggcgtgagccacggtgcccggccacatcttgatctttccgtaaagaaggtgctgatgatcgtcaggacccctttcttcctttgcctcttgcatgcattttctcctttggttcctgggtggttttgtgcaaagatccctagagaagctccgcttacagttagcccccacccaggaagcttgcttctacccacgtgacggaaactcatccctctaccatggccacagaacatagcttgtaagaaatcctgttgctcattgctaccggtcatttgtaatgtgcccatcagcataatgagcatctctcctgtattaactcttcccaagcctcaggcacaggtgagttcatcttacatatggggactacggagactagagaggttaaggaacctgcccagagtcacacagcttggagggaaatgatttggaacctaaatctagaacccatggtcacaaccgtcctgcccttctatctcatggacagtcctacccgctcgtacttgctcagccccaggccaggtgctgtgtacctgatactgtaccaacgttcacaccattactcctttaaggacccctttagatcaattgcattatcccattttacagagcgtgacgctgagactcaggggaagggacttgctgggtcactcagaggtcagagccgcattccagacctgcttttcccacggggccacgcgtgctcttctgaacggaagtcgttgtgtctggtgtcacagttggtctgtgggtgtctgccctccctggcctagcatgcggagttggccctgcgtaggtggctcccgcacaggtggcccgaatccacacacccactaggagggcaaggcccttattccttgcctgaaatgtcagaaacacctcccaactctttagccaaaactgtcatcttttttaaaaatccatcttcttacaccttggcttaaaacctgggtgacggctgactgcctcaggctaaaatcggaagtcttcatgacctggcctggccagctctcacaccccagctgcgcagcgagcacctgtactgggcgtgtgagggagaaggaacagtgcggcccctgacctcacaggacccactggagggtctgcaggcaggtacctgggtgctggagggtctgcaggcaggtacctgggcagtggcaaccctgcactagggccgtgagagagaagtggacggtgcagttggagccggggcgttagggggtgttggggggatctcgaagggaaatggtgtctaagttcagaactaacatgtaaataggagttttcctgggtgaaaggagggtgtggagaatagagttagaaacagcacaagctcaggttcagaggggacagagaccggaacattgccaaaagcgtgcagggcacagggagagccacaaagtgaggctgcgacagaaagcagcggctacatcccactgcgccccatggaccccgcaaagccgtaacctaagagcagaggccgaacaggaagtgttttaaggagggaaacagtgataccaggcttgttctagaaaaaccgttgttaatatctagaatatatggcggactcctacaaattagttgttaaaaaaaggcaacccaataggtagaagacttggcaaagtaattgagacagtgacagttcacagaaggggaacacaggtgcctcctgacatggtttgtcattgaccatctgtctttaaaacaaaccatgctggccaggggtggtggctcacacctgtaatcccagcactttgggaggccaagatgggaggatcactggaggctgggagttcaagagcagcctgggcaacacagtgagaccttgtctctacaaaaaatttaaaaattacgagcatgcacctatagtgccggctactcaggaggctgaggtgggaggatcgcatgagcccaggagttggaggctgcagtgagctatgattgcaccacagcccaggcgacagacctagacccagtctctaaaaacaaaaccatgctgcctcttgcctccacaccttggtgcattccgttccttctgcttagagtcctggccaccacctccttggcctttcctggccagctctctctcgtcctttaagcctcagcttgtgcctggcacctgatgttgagctgacctcctgtccgccttgtcctgtcacactggcattgcctgtgtgttggccgagcccggaggaaaggacccagggcccctcctggctctgaggactcctcagatctgtcgcccatgggggtgagagcggtgtgtggttttgaaggcgctgttcttggcggactcatccagttccactctgctatttctctaaacagtacccaatggagataggctatccttgatgattgaggaagagagtgctagctagcttaaagcatgaagtggcagcactgtaggagcctaggtttccagagctagagggacactgaatgccaagggctgttcccagcacgcccctgcccctgagcaccgggggccggggtgccatcattccatcattttcctctcagagctccccactaccccccagccctgccactgagcactggatgccaagtaaatgtttattggaccaaactgggtggtcatgtctgaaaatcgagcaaggcctgggatttgtcactatggctgagaccgcattctctgataagcctgggagaatttaactcgcatccttgggggaaaaaacaagaaaactaaatgcttcccttccaacactgaaatgctgggggaaagcagtgaaagaggtatttagagttctgaagactgaagttcagtcaacaagtatttcttgcttttcttgaccaaactacccaagtgctcagccgctggggacttgagtgccacccaaacttgtcagccactggggacttgcgtgccacccaagcttgtattaatcaggcactagcttcttttaaatattggatgcccaccagtataggggagccgtgcctctatcgaaaaataaaggcctgatgtggtggctcatgcctgtaatcccagcactttgggcggccaaggcgtgtggatcgcctgaggtcaggagttcgagaccagcctaaccaacatggtgaaaccttgtctctactgaaaatacaaaattagccgggcgtggtggcacgcacctgtaatcccagctactcgggaggctgaggcaggacaatcacttgaacctgggggcagaggttgcagtgagctgagattatgccattgtactccagcctgggcaacaagagcaaaactctgtctcaaac

SEQ ID NO: 7232 - DNA, 2692 bp, Homo sapiens
  ENST00000594346
aggggcacccagagagatggaatgaggcagactcggaggtctgtattttttattgtggtaaaatagctataccacaatattggccaacttaacgatttttacgggaacaattcagtggcattaagtgcctttacaaggtggtgcaactgctttgagtctctgctggtgatgtcactttggcaaagggacgaaatgagccaccagtgcgtcaggcctgctcagagttgtttggaggtagcatggacacaggtgcctgtccctgccccctagctgggctgcagcgcatcctaacaatgctccaggggctgggccggccctgagcctggaggtgggcagggctgcaactgcctcctgggccactagagggcatgtgggagccactcacatgcaccccaggccccacttcctgggtagggtgcctggcccctcaaaacgagtgctgctctgagcttgttgggatggatctttccctccttcagcttccgcctgctggcaatgcatggggtcctgcgcccccatttctgcctcggtgtcacagggcacacccctctcccctcaaggtggctcttctcctcaggacaccactcccgttggatttagggcccaccctaccccagtgtgatctcgtcttcactagttaccctgcaacgagcctatttccaaataagcctgtgttctaaggtactggtagtcaggacctcaacgtgtcttttggggggacacagggaccccaagatgccccacagcaagtgacaaggggaagtgatgagatcagggtcccaggacctgccaagtctccccacacacgggggagcgggggtggggcccacatccttcagtcacggacatgccccagcccagggccctggtgcagggagagctgctctctgtgccctcctggggcaggtgcccgctgtgcttctcacaggcctccttgcctttcagaatcagttgtctggaaacctgctgaggaaattcaaaaacagcaacgggtggcagaagctgtgggtggtgttcacaaacttctgcctgttcttctacaaatcacaccaggtaagtgtctcgcacagggcaggtggccctgggaccttgggggtggcagcatgaggtgagggggccgccctcctctggaatgactcaggcctcttgggctccaggtgtcacggggatgacagggatgctggcggggggccctgtccacccgaggccctcaactctagggaagactgacattatcatccactgaaggacaacttctgccctaggaagggccacctgtcttctgcctggacaagggacgggggttggctttatctacagctcagtcctggcgggacttgccacccgggccatcacgtacaggcaaacactggctgccatggtcccttccaggcccacgcccgaggagggagctgcctgggctcccaagtccctgtctgatgcggggcagcagccaggcccagcagcagaagctgaccccgaaaagccactttgctttgtttcccctttccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtagacacccccttcccacgcacagggccctgcagaagaggaccccctcttccaaacatcaggatttctcccaagtcagcgagtgagatggccccacccttccctgccaactaagcgtttagacctggggtcccactgcccgacaccagcaggcgattctgttctcatggcagaaagtggggtcccaacttccctgcgcccttaccctgcacggtgttggctgaggccctagacatcttgcttggagatctctgacataacgtgtccgggatgatgaagctaagccccagtgagactgcctacatggtgtaatggcagggactgcagacttcatttagccaagaaagaaatgcaacagtcaggcctaagactgttcctgcaattcatattttgaatagagatcctgggcctctgcaaattgcatccccaagccgactacttgtgcagtttgccctgctgagccctcctcgccccgggaggcagaaggggaggggtcctcagcaatatgctgagcacctcctaaacaacatcacctgaaaaaggaacctagaggagagccattctcaaatctgatcctggactgagctcgagagctgggttgagagctgggttgatcaaagttgggattttgctattattgtgacaaagggtccagccttgcagtccagatcctgaaaggcctgggacaaggccaggtaatttggggagtccgtcctgcattgtgcaggatgttcagcggcatccctggccacccactagatgcccgcagcaacccctcagttgggacatctaaaaatgtctccagactttaccaaatgggacagcattgcacccatttgagaagcaccggtagagagcaaatacacaaatatataaaaagggagatttgggcgtggtggtgcaagcctgtagtcccatctcctgggaggccaaggctggaggatcgattgagcccaggaggtagctacagtgggcgataactgcaccactgaactccagtatgagtgacagagccagaccctgtctc

SEQ ID NO: 7233 - DNA, 510 bp, Homo sapiens
  ENST00000600380
gcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcga

SEQ ID NO: 7234 - DNA, 439 bp, Homo sapiens
  ENST00000597596
tgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatgcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaac

SEQ ID NO: 7235 - DNA, 5103 bp, Homo sapiens
  ENST00000627049
ttcccgctcgccggcctcagaggcggcgggtccggcgcgggcgcagcggtgcgggcgctcggctggggcgcggggcggggacgcggccgctgcccgctttgcgccgctcctccctgcgcgagtagcgctggccccggcgtcgaggcggccatggcgacccggagcccgctccccacccaccccgcctgctccgccctcccctccgccccgcgccacctttgatggctcggacctcagccggccaccgccagccctgctcgcgcgcccgcgccgccgccgcccgcgggtattaatagccggcgccgccgcgccctcggccgccgggggcttgggagccgccgatcccggagcccgagccgggagagggagccgccgcagccgccggcgctgtggagatattctctaagccgctttcatcatgggagaaatagagcagaggccgaccccaggatcacgactgggggccccggaaaattcggggatcagtaccttggaacgtggacagaagccgcccccaacaccttcaggaaaactcgtgtccatcaaaatccagatgctggatgacacccaggaggcatttgaagttccacaaagagctcctgggaaggtgctgctggatgcagtttgcaaccacctcaacctcgtggaaggtgactattttggcctcgagtttcctgatcacaaaaagatcacggtgtggctggatctcctaaaacccattgtgaaacagattagaaggccaaagcacgttgttgttaagtttgtggtgaaattctttccgcctgaccacacacaactccaagaagaactcacaaggtacctgttcgcgctgcaggtgaagcaggacttggctcaaggcaggttgacgtgtaatgacaccagcgcagctctcttgatttcacacattgtgcaatctgagattggggattttgatgaagccttggacagagagcacttagcaaaaaataaatacatacctcagcaagacgcactagaggacaaaatcgtggaatttcaccataaccacattggacaaacaccagcagaatcagatttccagctcctagagattgcccgtcggctagagatgtatggaatccggttgcacccggccaaggacagggaaggcacgaagatcaatctggccgttgccaacacgggaattctagtgtttcagggtttcactaagatcaatgccttcaactgggccaaggtgcggaagctgagcttcaagaggaagcgctttctcatcaagctccggccagatgccaatagtgcgtaccaggataccttggaattcctgatggccagtcgggatttctgcaagtccttctggaaaatctgtgttgaacatcatgccttctttagactttttgaagagcccaaaccaaagcccaagcccgtcctctttagccgggggtcatcatttcggttcagtggtcggactcagaagcaggttctcgactatgttaaagaaggaggacataagaaggtgcagtttgaaaggaagcacagcaagattcattctatccggagccttgcttcacagcctacagaactgaattcggaagtgctggagcagtctcagcagagcaccagccttacatttggagaaggtgccgaatctccagggggccagagctgccggcgaggaaaggaaccgaaggtttccgccggggagccggggtcgcacccgagccctgcgccgaggagaagccccgcgggtaacaagcaggcggacggagccgcctcggcgcccacggaggaagaggaggaggtcgttaaggataggacccagcagagtaaacctcagcccccgcagccaagcacaggctccctgactggcagtcctcacctttccgagctgtctgtgaactcgcaggggggagtggcccctgccaacgtgaccttgtctcccaacctgagccccgacaccaagcaggcctctcccttgatcagcccgctgctgaatgaccaggcctgcccccggacggacgatgaggatgagggccggaggaagagattcccaactgataaagcgtacttcatagctaaggaagtgtctaccaccgagcgaacatatctgaaggatctcgaagttatcacttcgtggtttcagagcacagtgagcaaagaggacgccatgccggaagcactgaaaagtctcatattcccgaattttgaacctttgcacaaatttcatactaattttctcaaggaaattgagcaacgacttgccctgtgggaaggccgctcaaatgcccaaatcagagattaccaaagaatcggcgatgtcatgctgaagaacattcagggcatgaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacaccacccgccgagccacgccgacttcagggactgccgagccgctttggcagagatcacggagatggtggcacagctccacggtacgatgatcaagatggagaatttccagaagctgcacgaactcaagaaagatttgattggcattgacaatcttgtggttccgggaaggcctggctccttttcccttattaggactccacacttaggacaagccaggcgcatcccatgtgctccagagaggaggccattgttattagtaaaggagttcatccgtctgggcagcctcagcaagctctcggggaaggggctccagcagcgcatgttcttcctgttcaacgacgtcctgctatacacgagccgggggctgacggcctccaatcagtttaaagtccacgggcagctcccgctctatggcatgacgattgaggagagcgaagacgagtggggggtgccccactgcctgaccctccggggccagcggcagtccatcatcgtggccgccagttctcggtccgagatggagaagtgggttgaggacatccagatggccattgacctggcggagaagagcagcagccccgcccctgagttcctggccagcagcccccctgacaacaagtcccctgatgaagccaccgcggctgaccaggagtcagaggatgacctgagcgcctcgcgcacatcgctggagcgccaggccccgcaccgcggcaacacaatggtgcacgtgtgctggcaccgcaacaccagcgtctccatggtggacttcagcatcgcagtggagaatcagttgtctggaaacctgctgaggaaattcaaaaacagcaacgggtggcagaagctgtgggtggtgttcacaaacttctgcctgttcttctacaaatcacaccaggacaatcatccccttgccagcctgcctctgctcggctactcgctcaccatcccctctgagtccgagaacatccagaaagactacgtgttcaagctgcacttcaagtcccacgtctactacttcagggcggaaagcgagtacacgttcgaaaggtggatggaagtgatccgcagtgccaccagctctgcctcgcgaccccacgtgttgagtcacaaagagtctcttgtgtattgatggccggacacactcgtttccgcagtggctgctttcctggaagacgtttcctttcttctgtattaatgaagcctggtaaaattaacacctgtctgaaaatcaaaaacatggcttcccagcagctctcctgtctccacagccgcgttttttaaccccgacctctcagcgtctgaatgaacagcgctcccacctccagtcctggcatccgctgggggcgctgttctttagctagtgccagtattaaaacattgtcattacgagagtgccaaatgacatcttccctccaccctgcccctgaaaaacagtacacacacatccgttcaacacaagacagggcaagtgtttttcttcctaaaaaaagttctttcttttattattttcacctattggctgctgcattttacgaagtggacttcccggtgtttgtttgtttgtttgcaatacactcagtgcagccttaagcaaatgagatcattttcagatttcattttttttttcagtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttccaaccgtagcagggttgttttctgttaagcaaagccgagatccagtgcaatacctggactgtcaccgtcctgtgagtggtgtacacaatgggaagataataagccgtggtgttttgctgtctgtctgtgtcacaagcatgaaaacccgtgtgtcattgatcagcaccatttgtggtatgttccgtgatgagcgtttagtgagcctgctggctgcagagcactatgaaatcatggtacgtagtccccggcacctgtcgttattcctatatcctcctgcaactgtggtttgaaactgcgcattctctagtagtatatatcgtgcctgtcttcaaaaacatttccctttttatactcattccccccaggcatggggtagtgtcagtcggactgcacagggaacacggtttccagtggctttggcccctactcgggaaacgtctgcctgttctcgatggtgatggggtggctgccattcccttggttttcctaagccctttctaacgagagtctcaaacaagcggaggcgagggccaattcaaccccattctttccagcgccccgcaccatagcacctgcccacctgagaaccaggaacgcaccctctctgtggagctctgactggtgtagctggaaacaaacagcaacttgcaaacggacgaagagcctgccgtgtgttaatcatttgccttacaagatgtaccagacggtttccagtactaacaaagggaataaaaatacctcacgccacaatccagcatattgatgttttaaggcaaaacaacc

SEQ ID NO: 7236 - DNA, 14786 bp, Homo sapiens
  ENST00000441802
agcgtgaggcgccggcgccgagctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagcttta

SEQ ID NO: 7237 - DNA, 2224 bp, Homo sapiens
  ENST00000500085
gcctgacatacgctggcgtatgctacagaggtctctcctcattcctgacttccttggcaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagt

SEQ ID NO: 7238 - DNA, 1305 bp, Homo sapiens
  ENST00000512772
tgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgaatctttggctgctcctgacctcagcaaaccaagagggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgc

SEQ ID NO: 7239 - DNA, 854 bp, Homo sapiens
  ENST00000507105
gtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccc

SEQ ID NO: 7240 - DNA, 479 bp, Homo sapiens
  ENST00000509537
gcctgtctgaagtgcagtctctgagctccttccagtccgaatcgtgcgatgacaatggctgtgattgtcagaaacaaggaaaagaaagtaatatttgagttttctggccaaatttctggttcctcattccgcagtcactttcctccacttccatattccattttatttgtggtacatacatttctcagccatttggaattgtcatagatactggcgtaaggacatgctgtatggctgattgggcctctggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagca

SEQ ID NO: 7241 - DNA, 357 bp, Homo sapiens
  ENST00000509927
ctttccaagaagcctctagaggaaaagccttcccagccatacagtgcccgggaaagcctgtctgaagtgcagtctctgagctccttccagtccgaatcgtgcgatgacaatgcttccatagtgaccgtaatgcaccttgtcaatgctgtggttgacacggtgagcacagaagaatctttggctgctcctgacctcagcaaaccaagagggtatcactgggatacatcagattggatgccaagcgttcctctgccggacatacaagagttccccaactatgaggtgattgatgagcagacacccctgtactcagcagatccaaacgccatcgatacggactattaccctggaggctac

SEQ ID NO: 7242 - DNA, 428 bp, Homo sapiens
  ENST00000507662
aggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaagctcatcaaggagggattagtcttcagtctctaaggattgagcctgacatacgctggcgtatgctacagaggtctctcctcattcctgacttccttggcaggtgtcagagtgatatcgacgagtgctctggaaacccttgcctgcacggggccctctgtgag

SEQ ID NO: 7243 - DNA, 512 bp, Homo sapiens
  ENST00000512347
cagatgtgatgatctcctttcttaaatctttacatgtttgagaggctgaggcaggaggatcacttgaggctagaagtgaggcagcctgggcgttacagggaaaccccatctctacaaaaacttaaaaaatcagccaggcatgtggcatgcctctagttccagctactcaggaggctgaggtgggaggatccctgagcccgggagtttgaggatgcaatgagctgagattgcgccactgcactccagcctgggtggcagagcgagaccctgtctcaaaaaataaaaatattgaaaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacag

SEQ ID NO: 7244 - DNA, 462 bp, Homo sapiens
  ENST00000503253
aattttatactgaacatttttatatttaatctttcattactttagaattcatttctctgtgatgcagtcgtcaaatttattctttccaaacagagagccagtcatgctgggcttttcattaagcaaatagacgttttcccacagaattggatagtaaaatgttatcatcttaaataaaaccctaaatcagtctcaaggggtgcaggggagtcatactttaaaaaatatgcttaaacttggttctggtttattttttcctctgtgtgattcacagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagttt

SEQ ID NO: 7245 - DNA, 341 bp, Homo sapiens
  ENST00000508035
tgggaaaatgtggtggcattgcagaatgctggaagtaattttgatttctattcaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaagg

SEQ ID NO: 7246 - DNA, 1852 bp, Homo sapiens
  ENST00000509647
aagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtag

SEQ ID NO: 7247 - DNA, 14758 bp, Homo sapiens
  ENST00000614102
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaat

SEQ ID NO: 7248 - DNA, 4839 bp, Homo sapiens
  ENST00000520200
aggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtt

SEQ ID NO: 7249 - DNA, 14534 bp, Homo sapiens
  ENST00000261800
ggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtatgttctaaagccatcttcagagaatgtaggatttaaacttaatgctcgaactgggttgatcaccaccacaaagctcatggacttccacgacagagcccactatcagctacacatcagaacctcaccgggccaggcctccaccgtggtggtcattgacattgtggactgcaacaaccatgcccccctcttcaacaggtcttcctatgatggtaccttggatgagaacatccctccaggcaccagtgttttggctgtgactgccactgaccgggatcatggggaaaatggatatgtcacctattccattgctggaccaaaagctttgccattttctattgacccctacctggggatcatctccacctccaaacccatggactatgaactcatgaaaagaatttataccttccgggtaagagcatcagactggggatccccttttcgccgggagaaggaagtgtccatttttcttcagctcaggaacttgaatgacaaccagcctatgtttgaagaagtcaactgtacagggtctatccgccaagactggccagtagggaaatcgataatgactatgtcagccatagatgtggatgagcttcagaacctaaaatacgagattgtatcaggcaatgaactagagtattttgatctaaatcatttctccggagtgatatccctcaaacgcccttttatcaatcttactgctggtcaacccaccagttattccctgaagattacagcctcagatggcaaaaactatgcctcacccacaactttgaatattactgtggtgaaggaccctcattttgaagttcctgtaacatgtgataaaacaggggtattgacacaattcacaaagactatcctccactttattgggcttcagaaccaggagtccagtgatgaggaattcacttctttaagcacatatcagattaatcattacaccccacagtttgaggaccacttcccccaatccattgatgtccttgagagtgtccctatcaacacccccttggcccgcctagcagccactgaccctgatgctggttttaatggcaaactggtctatgtgattgcagatggcaatgaggagggctgctttgacatagagctggagacagggctgctcactgtagctgctcccttggactatgaagccaccaatttctacatcctcaatgtaacagtatatgacctgggcacaccccagaagtcctcctggaagctgctgacagtgaatgtgaaagactggaatgacaacgcacccagatttcctcccggtgggtaccagttaaccatctcggaggacacagaagttggaaccacaattgcagagctgacaaccaaagatgctgactcggaagacaatggcagggttcgctacaccctgctaagtcccacagagaagttctccctccaccctctcactggggaactggttgttacaggacacctggaccgcgaatcagagcctcggtacatactcaaggtggaggccagggatcagcccagcaaaggccaccagctcttctctgtcactgacctgataatcacattggaggatgtcaacgacaactctccccagtgcatcacagaacacaacaggctgaaggttccagaggacctgccccccgggactgtcttgacatttctggatgcctctgatcctgacctgggccccgcaggtgaagtgcgatatgttctgatggatggcgcccatgggaccttccgggtggacctgatgacaggggcgctcattctggagagagagctggactttgagaggcgagctgggtacaatctgagcctgtgggccagtgatggtgggaggcccctagcccgcaggactctctgccatgtggaggtgatcgtcctggatgtgaatgagaatctccaccctccccactttgcctccttcgtgcaccagggccaggtgcaggagaacagcccctcgggaactcaggtgattgtagtggctgcccaggacgatgacagtggcttggatggggagctccagtacttcctgcgtgctggcactggactcgcagccttcagcatcaaccaagatacaggaatgattcagactctggcacccctggaccgagaatttgcatcttactactggttgacggtattagcagtggacaggggttctgtgcccctctcttctgtaactgaagtctacatcgaggttacggatgccaatgacaacccaccccagatgtcccaagctgtgttctacccctccatccaggaggatgctcccgtgggcacctctgtgcttcaactggatgcctgggacccagactccagctccaaagggaagctgaccttcaacatcaccagtgggaactacatgggattctttatgattcaccctgttacaggtctcctatctacagcccagcagctggacagagagaacaaggatgaacacatcctggaggtgactgtgctggacaatggggaaccctcactgaagtccacctccagggtggtggtaggcatcttggacgtcaatgacaatccacctatattctcccacaagctcttcaatgtccgccttccagagaggctgagccctgtgtcccctgggcctgtgtacaggctggtggcttcagacctggatgagggtcttaatggcagagtcacctacagtatcgaggacagcgatgaggaggccttcagtatcgacctggtcacaggtgtggtttcatccagcagcacttttacagctggagagtacaacatcctaacgatcaaggcaacagacagtgggcagccaccactctcagccagtgtccggctacacattgagtggatcccttggccccggccgtcctccatccctctggcctttgatgagacctactacagctttacggtcatggagacggaccctgtgaaccacatggtgggggtcatcagcgtagagggcagacccggactcttctggttcaacatctcaggtggggataaggacatggactttgacattgagaagaccacaggcagcatcgtcattgccaggcctcttgataccaggagaaggtcgaactataacttgactgttgaggtgacagatgggtcccgcaccattgccacacaggtccacatcttcatgattgccaacattaaccaccatcggccccagtttctggaaactcgttatgaagtcagagttccccaggacaccgtgccaggggtagagctcctgcgagtccaggccatagatcaagacaagggcaaaagcctcatctataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccctcctgaaagggaacagcgaaggtttcttcaacatcaatgccctgctaggcatcattactctagctcaaaagcttgatcaggcaaatcatgccccacatactctgacagtgaaggcagaagatcaaggctccccacaatggcatgacctggctacagtgatcattcatgtctatccctcagataggagtgcccccatcttttcaaaatctgagtactttgtagagatccctgaatcaatccctgttggttccccaatcctccttgtctctgctatgagcccctctgaagttacctatgagttaagagagggaaataaggatggagtcttctctatgaactcatattctggccttatttccacccagaagaaattggaccatgagaaaatctcgtcttaccagctgaaaatccgaggcagcaatatggcaggtgcatttactgatgtcatggtggtggttgacataattgatgaaaatgacaatgctcctatgttcttaaagtcaacttttgtgggccaaattagtgaagcagctccactgtatagcatgatcatggataaaaacaacaacccctttgtgattcatgcctctgacagtgacaaagaagctaattccttgttggtctataaaattttggagccggaggccttgaagtttttcaaaattgatcccagcatgggaaccctaaccattgtatcagagatggattatgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccaggcatggagcttctcatggtgcgggccagcgatgaagactcagaagtcaattatagcatcaaaactggcaatgctgatgaagctgttaccatccatcctgtcactggtagcatatctgtgctgaatcctgctttcctgggactctctcggaagctcaccatcagggcttctgatggcttgtatcaagacactgcgctggtaaaaatttctttgacccaagtgcttgacaaaagcttgcagtttgatcaggatgtctactgggcagctgtgaaggagaacttgcaggacagaaaggcactggtgattcttggtgcccagggcaatcatttgaatgacaccctttcctactttctcttgaatggcacagatatgtttcatatggtccagtcagcaggtgtgttgcagacaagaggtgtggcgtttgaccgggagcagcaggacactcatgagttggcagtggaagtgagggacaatcggacacctcagcgggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcagtgaactggcaacctgtggacacctggttcttaaagtccaggctattgaccctgacagcagagacacctcccgcctggagtacctgattctttctggcaatcaggacaggcacttcttcattaacagctcatcgggaataatttctatgttcaacctttgcaaaaagcacctggactcttcttacaatttgagggtaggtgcttctgatggagtcttccgagcaactgtgcctgtgtacatcaacactacaaatgccaacaagtacagcccagagttccagcagcacctttatgaggcagaattagcagagaatgcaatggttggaaccaaggtgattgatttgctagccatagacaaagatagtggtccctatggcactatagattatactatcatcaataaactagcaagtgagaagttctccataaaccccaatggccagattgccactctgcagaaactggatcgggaaaattcaacagagagagtcattgctattaaggtcatggctcgggatggaggaggaagagtagccttctgcacggtgaagatcatcctcacagatgaaaatgacaaccccccacagttcaaagcatctgagtacacagtatccattcaatccaatgtcagtaaagactctccggttatccaggtgttggcctatgatgcagatgaaggtcagaacgcagatgtcacctactcagtgaacccagaggacctagttaaagatgtcattgaaattaacccagtcactggtgtggtcaaggtgaaagacagcctggtgggattggaaaatcagacccttgacttcttcatcaaagcccaagatggaggccctcctcactggaactctctggtgccagtacgacttcaggtggttcctaaaaaagtatccttaccgaaattttctgaacctttgtatactttctctgcacctgaagaccttccagaggggtctgaaattgggattgttaaagcagtggcagctcaagatccagtcatctacagtctagtgcggggcactacacctgagagcaacaaggatggtgtcttctccctagacccagacacaggggtcataaaggtgaggaagcccatggaccacgaatccaccaaattgtaccagattgatgtgatggcacattgccttcagaacactgatgtggtgtccttggtctctgtcaacatccaagtgggagacgtcaatgacaataggcctgtatttgaggctgatccatataaggctgtcctcactgagaatatgccagtggggacctcagtcattcaagtgactgccattgacaaggacactgggagagatggccaggtgagctacaggctgtctgcagaccctggtagcaatgtccatgagctctttgccattgacagtgagagtggttggatcaccacactccaggaacttgactgtgagacctgccagacttatcattttcatgtggtggcctatgaccacggacagaccatccagctatcctctcaggccctggttcaggtctccattacagatgagaatgacaatgctccccgatttgcttctgaagagtacagaggatctgtggttgagaacagtgagcctggcgaactggtggcgactctaaagaccctggatgctgacatttctgagcagaacaggcaggtcacctgctacatcacagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacagcttctctatactggcaaggttcatgaagatgtatttccaggacacttcattttgaaggtttctgccacagacttggacactgataccaatgctcagatcacatattctctgcatggccctggggcgcatgaattcaagctggatcctcatacaggggagctgaccacactcactgccctagaccgagaaaggaaggatgtgttcaaccttgttgccaaggcgacggatggaggtggccgatcgtgccaggcagacatcaccctccatgtggaggatgtgaatgacaatgccccgcggttcttccccagccactgtgctgtggctgtcttcgacaacaccacagtgaagacccctgtggctgtagtatttgcccgggatcccgaccaaggcgccaatgcccaggtggtttactctctgccggattcagccgaaggccacttttccatcgacgccaccacgggggtgatccgcctggaaaagccgctgcaggtcaggccccaggcaccactggagctcacggtccgtgcctctgacctgggcaccccaataccgctgtccacgctgggcaccgtcacagtctcggtggtgggcctagaagactacctgcccgtgttcctgaacaccgagcacagcgtgcaggtgcccgaggacgccccacctggcacggaggtgctgcagctggccaccctcactcgcccgggcgcagagaagaccggctaccgcgtggtcagcgggaacgagcaaggcaggttccgcctggatgctcgcacagggatcctgtatgtcaacgcaagcctggactttgagacaagccccaagtacttcctgtccattgagtgcagccggaagagctcctcttccctcagtgacgtgaccacagtcatggtcaacatcactgatgtcaatgaacaccggccccaattcccccaagatccatatagcacaagggtcttagagaatgcccttgtgggtgacgtcatcctcacggtatcagcgactgatgaagatggacccctaaatagtgacattacctatagcctcataggagggaaccagcttgggcacttcaccattcaccccaaaaagggggagctacaggtggccaaggccctggaccgggaacaggcctctagttattccctgaagctccgagccacagacagtgggcagcctccactgcatgaggacacagacatcgctatccaagtggctgatgtcaatgataacccaccgagattcttccagctcaactacagcaccactgtccaggagaactcccccattggcagcaaagtcctgcagctgatcctgagtgacccagattctccagagaatggccccccctactcgtttcgaatcaccaaggggaacaacggctctgccttccgagtgaccccggatggatggctggtgactgctgagggcctaagcaggagggctcaggaatggtatcagcttcagatccaggcgtcagacagtggcatccctcccctctcgtctttgacgtctgtccgtgtccatgtcacagagcagagccactatgcaccttctgctctcccactggagatcttcatcactgttggagaggatgagttccagggtggcatggtgggtaagatccatgccacagaccgagacccccaggacacgctgacctatagcctggcagaagaggagaccctgggcaggcacttctcagtgggtgcgcctgatggcaagattatcgccgcccagggcctgcctcgtggccactactcgttcaacgtcacggtcagcgatgggaccttcaccacgactgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccatggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgt

SEQ ID NO: 7250 - DNA, 18699 bp, Homo sapiens
  ENST00000525166
agtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctccatagtgactgtcattcagcttgtcaacaatgtagttgacactatagagaatgaagtgtctgtcatggaccaaggacagaactacaaccgagcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagtaaaaagaaaaaaatgaaa

SEQ ID NO: 7251 - DNA, 535 bp, Homo sapiens
  ENST00000528921
cctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacagg

SEQ ID NO: 7252 - DNA, 7894 bp, Homo sapiens
  ENST00000533797
ctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttct

SEQ ID NO: 7253 - DNA, 581 bp, Homo sapiens
  ENST00000489716
cgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgg

SEQ ID NO: 7254 - DNA, 481 bp, Homo sapiens
  ENST00000469900
tgtggagctaaattattttctctaagcaaatgaaagtgcctcgagaagtgaactagctgagaggggtgggtgggactggaaataggcacaaggtaaccagtgtaatttctgctttctctttcactgtccatgaagacaaaggggttgatgacccgggagaagtgacctgctttgcaggtagtaataaaggcagcaactctgaagttcagtccctcagctccttccagtcagattctggtgacgacaatgcctccatagtgactgtcattcagcttgtcaacaatgtagttgacactatagagaatgaagtgtctgtcatggaccaaggacagaactacaaccgagcctatcactgggacacctctgattggatgccaggggcccgcctgtcggacatagaggaagtgcccaactatgagaaccaggatggagggtctgcacaccaggggagcacacgggagctggagagcgattactacct

SEQ ID NO: 7255 - DNA, 19030 bp, Homo sapiens
  ENST00000409404
gatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagcccagtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacaggtctgattacaacaacttcaaggaaattggatcgagaacagcaggcagaacattttctggaggtgactgtgacagatggtggtccctctccaaaacagtcaaccatttgggtggtggttcaggttctagatgaaaatgacaacaagccccagttcccagagaaggtctaccagatcaagctgccagaacgtgaccgaaagaagagaggagaaccgatttacagggcttttgcatttgatagagatgagggccccaacgcagaaatctcctacagtattgtggatgggaatgatgacggaaagttctttattgaccctaaaactgggatggtttcttctagaaagcagtttacagcaggcagttatgacatcctaacgataaaggcagtggacaatgggcgcccacagaaatcctccacggcccgcctccacattgaatggattaagaaaccacccccttcacctataccattgaccttcgatgagccgttttataacttcacagtcatggaaagtgatagagtgactgaaattgtaggggtggtgtctgtgcagccagctaacacccctctgtggtttgacatagttggggggaattttgacagcgcttttgatgcagagaagggtgttgggacaattgtcatcgcaaaacctttggatgcagagcagaggtccatctataatatgagtgtggaagtcaccgatgggacaaatgttgctgttactcaggtatttatcaaagtgctggataataatgataatggcccagaattctctcagccgaattacgatgtgacaatttccgaggatgtgcttccagacacggagatcctgcagattgaagccacagatagagatgagaagcacaagctgagctacactgttcatagcagcatcgactccatcagcatgagaaaattccggattgaccctagcactggcgtgctctatactgccgagaggctggaccatgaggcccaggacaagcacattctcaacataatggtcagagatcaggagtttccttatcgaagaaacttggcccgagtcattgtgaatgtggaggatgctaatgatcacagtccttattttaccaacccactgtatgaagcgtctgtgtttgaatctgctgctctgggatcagctgttctgcaagtgacggctctggacaaagacaaaggagaaaatgcagaactcatatataccatagaagcagggaacactgggaacatgtttaagatcgaaccggtcctaggcatcatcaccatttgcaaagaaccagacatgacgacgatgggtcagtttgtcctatccatcaaagtcacagatcagggatccccgccaatgtctgctactgcaattgtgcgcatttccgtcaccatgtctgacaattctcaccccaagttcattcacaaagactaccaagcagaagtaaatgaaaatgttgacattggaacatcagtcattctaatctctgccatcagtcaatctaccctcatttatgaagtcaaagatggagacattaatgggatctttaccataaatccatattctggagtcatcaccactcagaaggccctggattatgagcgcacatcctcttatcaactcatcattcaggccaccaatatggcaggaatggcttccaatgctacagtcaatattcagattgttgatgaaaatgataatgccccagtttttctcttttctcaatactcaggcagcctaagtgaggctgccccaattaatagcattgtcaggagcttggataacagcccactggtgattcgagccacagatgctgacagcaaccggaatgctctgcttgtgtatcagattgtggagtcaacagcaaaaaagtttttcacggtggactccagtacaggtgcaatcagaacaattgccaacctggaccatgaaaccattgcccatttccattttcatgtgcatgtgagagacagtggtagcccccaactgactgcagagagtcccgttgaagtcaacattgaggtgacagatgtgaatgataacccacctgtttttactcaggctgtgtttgagactatcttacttctacctacctatgttggagtggaggttctgaaagttagtgccacagatcctgactctgaggtaccccctgaactgacatacagcctaatggaaggcagtttggatcattttttaattgactcaaacagtggagtacttaccataaaaaacaacaacctctccaaggatcactacatgctgatagttaaggtgtctgatggaaagttctacagtacctccatggtcaccatcatggttaaagaagccatggacagcggcctccactttacacaaagcttctattccacctcaatctcagagaacaacactaacataaccaaagttgctattgtcaatgcagttggaaatcgccttaatgagcccttaaaatacagcatcttaaacccaggaaataagttcaagataaaatctacctcaggggtcattcagacgactggagtcccctttgaccgtgaagaacaagagttatatgagctggtggtagaagccagccgtgagctggaccatctgcgtgtggccagagtggtggtcagggttaacattgaagacataaatgacaattctccagtctttgtgggcctcccatactatgctgctgttcaagtggatgcggaacccgggactctgatttatcaggtgacagccattgacaaagataaaggtccaaatggagaagtgacctatgtcctgcaggatgactatggccactttgaaattaaccctaattcagggaatgttattttaaaggaagcattcaactctgacttgtccaacattgagtatggagtcaccatcctagccaaggatggcggaaaaccttctttgtctacatctgtggagcttcccatcactattgtcaacaaagcaatgcctgtgtttgataagcccttttatacagcatctgtcaatgaagacatcagaatgaacacacccatcctaagcatcaatgccaccagtccagaaggccaaggcatcatatatatcattatcgatggggacccttttaaacagtttaacattgactttgacactggggtcctgaaagttgttagccctttggattatgaagttacatctgcttacaagctgacaataagagccagcgacgcccttactggtgctagggctgaagtcactgttgacttgctagttaatgatgtaaatgacaacccccctattttcgatcagcctacatacaatacaacactatcagaagcatctcttattgggacacctgttttacaagttgtctctattgatgcagactcagaaaacaataaaatggtacattatcagattgtccaggatacctacaatagcacagattattttcacatagatagctcaagtggcttaatcctgacagcacgaatgctggaccatgagttagtacaacactgcactttgaaagtcagatcaatagatagtggcttcccatcactgagcagtgaggttctcgttcatatctacatctctgatgtaaatgacaaccctccagtttttaatcagctcatttatgagtcatatgtgagtgaattagccccccggggccattttgtaacctgtgtacaagcctctgatgcagacagctctgattttgaccggttggaatatagcattttatctgggaatgaccggacgagctttctgatggacagcaagagtggagttatcacattgtccaaccatcggaagcagcggatggagcctctgtacagtctcaatgtgtctgtctctgatgggttgttcaccagcactgcacaggtgcatattagggtacttggggctaacttgtacagccctgccttttcacaaagcacatacgtagctgaggtgagagagaacgtggctgcaggaacaaaggtaattcatgttcgagccacagatggtgatccagggacttatgggcagatcagctatgccatcatcaatgactttgccaaggatcgattcctcatagacagcaatgggcaggtcatcaccacagaaaggctagaccgggaaaaccctctagaaggggatgttagtatttttgtgagggcccttgatggtggagggagaacaactttctgcactgtgagagtgattgttgtggatgaaaatgacaatgctccccagttcatgacagtggaatatagagccagtgtcagggcagatgttggaaggggccacttggtcactcaagttcaagccatagatcccgatgatggagcaaattcaaggattacttattccctctatagcgaggcctctgtttcagtggccgacctcctggaaatcgatcctgacaatggctggatggtcacaaagggtaattttaaccagctgaaaaatacagtgctttcgttctttgtcaaagcagtagatgggggcatcccagtaaagcactccctcattcctgtctatatccacgtcttgccccctgaaacgttcttgccatcattcacccagtctcagtattcctttaccattgcagaagatacagccattgggagtacagtggacaccctgaggattttgcccagtcagaatgtctggttcagcacagttaatggggaacggccagaaaataacaaagggggcatattcgtcatagaacaggaaacaggcactattaagcttgacaaacgccttgaccgtgaaaccagcccagctttccactttaaagtagcagccactatacccctggacaaagtagacattgtgtttactgtggatgtagatatcaaggtattggatttgaatgacaacaagccagtctttgaaacttcaagctatgacaccattataatggaagggatgcctgttggcaccaaactcacacaagtgagagctattgatatggactggggagccaatggacaagtcacttactccctccactcggattcccagcccgaaaaggtaatggaagcattcaatattgacagcaacacgggctggatcagtaccttgaaggacctagatcacgagacagaccccacattcaccttctctgtggtggcctctgaccttggagaggcattctctctttcctccacggccttggtctctgtcagagtgacagatataaatgacaatgcaccagtcttcgcgcaggaagtgtaccgagggaatgtgaaggagagcgacccaccgggcgaggtggtagccgtcctcagcacctgggacagagacacatccgacgttaatcgccaagtgagctaccatattacaggaggaaaccctcgaggaaggtttgctctgggcctggtgcaaagtgagtggaaggtctatgtgaagaggcctctagacagagaagaacaggacatttactttctcaatatcactgccactgatgggctttttgtcacacaggccatggtggaagtgagcgtcagtgatgtgaatgacaatagcccagtgtgtgatcaggttgcatatacagcattacttcctgaagacattccatcaaataaaatcatcctgaaagtcagtgcaaaggatgctgatattggatccaatggatatatacgatactcactctatggatctggaaacagtgaattttttctagatccagaaagtggcgagttaaaaaccttggctctgttggaccgggagaggatccccgtgtacagcctgatggccaaggccactgacgggggtggcaggttctgccagtccaacatccacctaatcctggaggatgtgaatgataacccccctgtgttttcttctgaccactacaacacctgtgtctatgagaacacagccaccaaggctctgttgaccagagttcaagccgtggaccccgacattggcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggtgtctggatactctctgcttgtccaggccgtagacagtggcattcctgcaatgtcatcaactgcaactgtcaacattgatatttctgatgtgaatgacaacagcccggtgtttacacctgccaactatactgctgtgattcaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatggaggactgtgtccggggtccaacgatccttgtgtggagaagccgtgtccaggggacatgcagtgtgtcagttatgaagccagcaggagaccgttcctctgccagtgtccaccagggaagctcggagagtgctcagggcacacttctctcagctttgctggaaacagttacatcaaatatcggctttctgaaaatagcaaagaagaggatttcaaactagctctgcgtcttcgaacactgcaaagcaatgggattataatgtacaccagagcaaatccctgcataattctgaagattgtggatggcaagctgtggttccagctggactgcggcagcggccctggaatcttgggcatctcgggccgtgctgtcaacgacgggagctggcactcggtcttcctggagctcaaccgcaatttcacgagcctgtccctggatgacagctacgtggagcggcgccgggcgcccctctacttccagacgctgagcactgagagtagcatctacttcggcgccctggtgcaagcggataacatccgcagcctgactgacacgcgggtcacgcaggtgctcagcggcttccagggctgcctggactcggtgatactgaataacaatgagctgccgctgcagaacaagcgcagcagcttcgcggaggtggtgggcctgacggagctgaagctgggctgcgtgctctatcccgacgcctgcaagcgcagcccgtgccagcacgggggcagctgcactggcctgccatcggggggctatcagtgtacctgtctctcacagtttacggggagaaactgtgaatctgagattacagcctgcttcccaaacccctgccggaatggaggatcctgcgatccaataggaaacactttcatctgcaattgtaaagctgggctcactggagtcacgtgtgaggaggacatcaatgagtgcgaacgagaggagtgtgagaacggaggctcctgcgtgaacgtgttcggctccttcctctgcaactgcacgccgggctacgtgggccagtactgcgggctgcgccccgtggtggtacccaatatccaggctggccactcctacgtggggaaggaggagctcatcggcatcgccgtggtcctcttcgtcatcttcatcctggtggttctcttcatagtcttccgcaagaaggtcttccgcaagaactactcccgcaacaacatcacgctagtgcaggacccggccaccgccgccctgcttaacaagagcaatggcatcccgttccggaacctgcgcggcagtggggacggccgcaacgtctaccaggaggtggggcccccgcaggtccccgtgcgccccatggcctacacaccctgcttccagagtgactccaggagcaacctggataagatcgtggacgggctgggaggcgagcaccaggaaatgaccacgtttcaccctgagtcgccccgcatcctgacagcccggcggggcgtggtcgtgtgcagtgtggcccccaacctccccgccgtgtcaccctgccgctccgactgcgactccatccggaagaatggctgggacgcgggaactgagaacaaaggggttgatgacccgggagaagtgacctgctttgcaggtagtaataaaggcagcaactctgaagttcagtccctcagctccttccagtcagattctggtgacgacaatgcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattaaaaactggcaacaatcaaagaggcattgttgcatgtaattttgagccaatgaaatgaaaatagtagtaatgattgttggaaaagttagtctcttaggcgaaagagaagagaaacaaatattattaaacaaaccagaaaatgggctgaagccttttaaatcaactctatttttttgataagctgcccaattttcagctataaaattaggcttgaataacatgtttagtatgctcagttatttctgtttgtttgtgttaagcatccaatctaatatagttgggttttatgatcttcaagaaaggtatcaatgaagagcaacatgaggctttttgggttccatttggtgggtgggggaggaagttaaagttgtttgaacattagaaagaatgtgattatctggttggttttgtgttttctggtaaatattccagttggtaaatctaacattgctacagaagttggctttgttcatatagcttctctacaattagatatttttagaagtttaagcaaaactcacaaattcaggggggaaaaaagaaaaaacgataccttcaaagtttgcggcctagataatcacaattcttcataatgcagaggaaaggtgtctgttattctaaatcggtagcatcaccattataaatacaattatgttaagaaaagaggaaagtagactagttattgtgtataaattataatagtgtgtgtgtgtctgggcctatgtacaaatatgtgcttgcactcagtaaggctgctcttgaggaaagctaatgtgaaggttttgggaaatggaccatgttgaaaattctgccggcgagcatggcatacctttcaatttctctgatctctatggtgttagagaaacatcaaatgccatattttactctggttcagttaactttattttggtactgccaataaagcaaaattgtgcttttttttttttttctcaagacagagtcttgctctgtcacccaggctagagtgcaatggcatgatctcagctcactgcaatctccacctcctgggttcaagcgattctcctgcctcagcctcccaggttgctggggttacaggtgtgtgccaccacgcctggctaattttttgtatttttagtagagatggggtttcaccatgttggccaggctggtctcaaactcctgacctcgtaatccacctgccgtggcctcccaaagtgctgggattacaggcatgagccaccgtgcccagcccaaaactgtgctttttaaaaacagtattttgttataattttccagaacttacctctgttttaaaagtgtgtaatgtttgattacaccctgggattcccttctcatctgtgggctttggccatgatttccaaaattaacaggagaatcattccactggaaatataacaatccagtcctcaaaactgaaagttgacaggttgagggactttccttttttgcttcaatcagattacggccgcctgtgcagtggccatggtaaatatatgcatatttgcactatctgcttaatgagcaaatctgtgtccacagtttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacactttaagtaatgcaatgacataaaaaccatcaaagtaaaaccaacatgtcatttcctgcccccaggaaatattagaatgagattaatgctgatgagtccctactgcttacacagcatctctttgagggagaatgcctgactgacacagtaatgaaagaataaatagatcctaatgcagtcatgaagccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaactccttattttatcaaagaggaaacatacccagagtgggaaagagacttgcccaagcccacagaggaagttaattcgcttaacaaggagtagaacccatccatctagccaatattctttttacatcatattgttcacccctacactgccttgagcatgggagtcacctggttctgatggaccctctgacttccaccattccttctttggaatatgctataaaagaaaattcatggagaatatttttctgaaagcctcatgatcttatgtttccttgcagtccccctagggagaggggttatagaattcatacatttctgtagacattcatcgaaatgctgcttttgccaaatgaatgtttgtataatagggatgaaatgataattacagagttcagctcagaccagtcatcagttgtagtgaaactttgattatactgttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacctcctggaagccatttcccataatctgttgtaggcactttactagtattgcacacattctggttaggttgagaatagctagactcttggtgctcgtcatatagtaagcaagaacttgggagtaataaaaggtgaataaaatgcatgcttcatttattccctttcctctatgaatattttgctgctgcattctagtctatgccagctttccatgtacccttggcctgcctattcatgaaatgccatataaaagacttaggaacatgagtaggtggtccatgctttgaggttcatccaattagggaataaatgtgaaaggctggaaagggaactagtttctgggatttgcctggaacttcccttggacattactagcacattctggaaaaaaagcaagttgaacatatctaccatcagtcctctcctacttacttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattgtccagataattggctcttcactccgctgccttcccagtgcacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagt

SEQ ID NO: 7256 - DNA, 19030 bp, Homo sapiens; identical to SEQ ID NO: 7255
  ENST00000634703

SEQ ID NO: 7257 - DNA, 18699 bp, Homo sapiens; identical to SEQ ID NO: 7250
  ENST00000634649

SEQ ID NO: 7258 - DNA, 535 bp, Homo sapiens; identical to SEQ ID NO: 7251
  ENST00000634625

SEQ ID NO: 7259 - DNA, 7894 bp, Homo sapiens; identical to SEQ ID NO: 7252
  ENST00000634743

SEQ ID NO: 7260 - DNA, 581 bp, Homo sapiens; identical to SEQ ID NO: 7253
  ENST00000634894

SEQ ID NO: 7261 - DNA, 481 bp, Homo sapiens; identical to SEQ ID NO: 7254
  ENST00000634756

SEQ ID NO: 7262 - DNA, 4318 bp, Homo sapiens
  ENST00000404922
agccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 7263 - DNA, 4127 bp, Homo sapiens
  ENST00000295760
ggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 7264 - DNA, 584 bp, Homo sapiens
  ENST00000465610
acacatacacgccccattgggagcagctgtggagatgtgaggacagtgaggtctgctattctcccagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggc

SEQ ID NO: 7265 - DNA, 4193 bp, Homo sapiens
  ENST00000492059
gattcccttcatttatttcatcatggggctcatgcctgcctggcgttcagttctctacagatttgctcttgggtttattatctgcccctccacccctgagggtgtcagtgctgtgaggacgctgggaacctgtcttgctggctgataaacccctggttcctagaggggctgggtgcagaggaggcgttcctttagaaatggggcaggcttggggaccactgctgtggtaacgagtcctgctgtccctctgtcactgccctatggggctgcgctttaggctgggagtcggagaaggagctcttgcctgtgactttggggagcacgctgtctataagagtcagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgc

SEQ ID NO: 7266 - DNA, 567 bp, Homo sapiens
  ENST00000477845
ttcatctccatttatcagtccctcccctgagcctagctccaggctggggccagagattgggcagtgataactgtctctccctgcagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccac

SEQ ID NO: 7267 - DNA, 537 bp, Homo sapiens
  ENST00000295761
acatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaa

SEQ ID NO: 7268 - DNA, 427 bp, Homo sapiens
  ENST00000421373
acgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgc

SEQ ID NO: 7269 - DNA, 11756 bp, Homo sapiens
  ENST00000316623
gtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgca

SEQ ID NO: 7270 - DNA, 4901 bp, Homo sapiens
  ENST00000559133
ctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacgtcatcctttctcttttactgctgtctccagctttcccctcttgcttcttctcacccaggacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttt

SEQ ID NO: 7271 - DNA, 660 bp, Homo sapiens
  ENST00000561429
gagacttccaaaaattataaatcagaaataatgagaaactcatggttttcccccttctagctgatttttttaaaatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatgg

SEQ ID NO: 7272 - DNA, 686 bp, Homo sapiens
  ENST00000560720
cagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttggtgagtacagttggcaccgcactttcctaacctcagcctccacactgggatgctggaaacccagacttcttatttaaaatacaagaaaatgtcaaaatctgaggaaggataaaaaatgttcatattttggagatgccgtaatgactgtgattgtccattgggctcagcaccaccctgcagctaaattcttcctttgctaattggatcctgaatcacttgtttggaatttcttggctgcctttgaagcccttggtgatcaggatccacttccgtatgtttctctgcccctctgtctgtaagcatggctattcccctgtatttctgggagcagagagagttataagcttgtctaggccaatgtctttctgcctacttactgaatgtcttatttgtttccctcag

SEQ ID NO: 7273 - DNA, 3766 bp, Homo sapiens
  ENST00000537463
agagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacaacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactg

SEQ ID NO: 7274 - DNA, 579 bp, Homo sapiens
  ENST00000560820
ggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatggtatgtctgtcatctgcatttctctctgggccatgcagggtgcagactggccatgatgtaagtaagactgtaggccttaaagacagtaacacaatttaatttaattgtaagtctaattagaatgttcattaaaaattattttatct

SEQ ID NO: 7275 - DNA, 4109 bp, Homo sapiens
  ENST00000560355
gggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactctccctgtggaagactccttggcaagacctcctgggggcaccttagaggtgctagggttgtttagtccccaccccgttcgtggttaaactaccttgcccctactcccagagatttctgccccaaaggagaggacgtggttaaatggaatcttgggccattgttgaggcagattttgggaggcgagaagagttccttggggaagaaggggaggagttgcgagtgggataagaggagaagcccgttcctttccctgcaatatcaattctggttgtttctagaggaaagtactttccttggggtcatcttggtagatgctgtatttgaaagggggcaaggaaaggaagggattcccatgacagtcagaggagaaatcacacagtagttgactcttccgtaaattatgcttattaaaattacggattgggttttctgggcaatgcttcctttagatgtctacattggaagcagaacagggcaagtggttctgagaactggttttttgagttgtgtggggctctccgtttcactgcagcagtaaggctgctgtggccggccttaagggagtatttttaactagtggtgtttgtgttgtgtacatgcaactgaccatttcactggcttcccatgccgctgttacagatgtttcagccggaaaaattttaattagacttgactaagggttgtcattttcctgtattgaaggacagtgggaatacatttcctttaagagaaatttgtctgcagttgtttaagttaaagcctccatggaaacaacaggatggactgtcagtgaccccttttatcttcttggaggagcctgttaaataaattcagacagtatatatagggagattttgtattaaattcttaccattctcgctgatgctcttttcctgagtggttctgtagctttattatatagctctgggtcaccaagtgatggtatccacttggatatgtggctgttcatttcacttactctttttttgttatgaggtgttatagtcatgtatatgtagtaaaatttgtgtttgtatggcccagatatgagaagaaaaagtaaactcaccagaccagtttttgactcctagtctggagtaaggacaagatgattgtatgagccaagcacttaggctgtgataaaatagcacagaaaatagttatgattaattcggttccatcttggccttcgtggaaaataaacccagaattccgataatgttggaaggaagtttgcttatcatggtaaacctgaccttgatcagacagcagatgtttattgccctgtgtgcaaggcacatggcaagttcaataagtagactgaggctctgattttcatatgttctcaagaggacctcatttagtccagtatttttccttcaaaaatacatttctcctacataataatatcttaatatctattctgataggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacgggggtgaaaataataatttaaaaatatatacaattaaaagtatttccctgccacctttcagagaccattttcttgtgtatttttctataaatcttttaggcatatgtatacatgtacaaataaacacaaatatatatgtatacatacacatgtgtgtgtgtatcctttttaatacatggaatgtattgtacatgcaatattctgaactttacttactttttatgtatctttaatgcatccatctattaactcatatggatctacctcattcattttctttctttttttttgagacacagtcttgctctgttgcccaggctggagtgtagtggtgcaatcttggcttactgcctccaccttcccggctcaagcgattctcctgcctcagcctccagagtagctgggattacaggtgggtgccaccaagcccggctaattttttgtatttttagtagagatggggtttcgccatgttggccaggatggtctcaaactcttggcctcaagcgatccacccacctctgcctctccaaattacaggcttgagccactgcgccctaccccattttcttgttgtatagaacctcattatgtcactggaacagttccctagtgatggctctttagattacattgagtcttttgctattaccaactttcttctgcatacctgtgtttacatacacgtgtttatatgtggtataaattagtaaaaatagaattgctggatcaaagtctttcccatagattttaagcaaaccccaattcttatgttaaatttgaataacattttaaatttattccctctgcttattgccgttacagtctcatatgaataaatcctttaacggtgccctgctgtataaatcatcagaaaaagcagttatgtactacatttttccagttattgcttaaaatttctgtttttgtctgttaaaatattaccggcttcaaaactcacctctttgactacagtgaaacctgtttaccattctgattggagatgcacagtttatgaagtgaaagtgatttgtaacccccgagtctgcctgatgcccagttggtggcagcaactttcagcacctcactaatctttcctctagttaaaaggtaccttaaactcatcagtatctgctgtgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttcttttttttttttattctctccccactgggcagcaaaagttgttccacagtggaaatttaggcatcctcaagtttcttcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgcttgatatgtgaaatgggtttatgaaaaataataaaatcataacgcta

SEQ ID NO: 7276 - DNA, 482 bp, Homo sapiens
  ENST00000558230
gcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctc

SEQ ID NO: 7277 - DNA, 11132 bp, Homo sapiens
  ENST00000508053
ggcagttagggcaactggaaggctgggagctgaaatcacctgaagtctcattcactcacatgtctgatggttgatattgtctatcagattcttttttgtctccttctctgcaagaggctggcaccagatcacctcctgagtagagcagacattccaaaggatgtcctgccaacaataatggaaagctggatacaactgaatatgtaaaatgatgttaatgaagaattgaagagcactgtatctagttttctgctctccccttattttgaatcaaacccaggcatcctatcatttcatctataaagactttagttcctaaaagtggaattgctggatcaaagggtaaaggcataggcaattctagagcatttagatttaatgtgatggacaggaatgaaccatgaagccacgagtgtttgatttttaaattgtgatattccactaaatgagaaatgaccaggacttcacagagatttcatgaaaggagggccacaaaggaagaacccagagcaggccggtgagaggcactctaagagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaa

SEQ ID NO: 7278 - DNA, 1884 bp, Homo sapiens
  ENST00000507835
tctactgaaaacatacccttgtactgttagccagcaatttccccaacttttcaagcatgcagcaccttcgcttggaaggccaagtctatctcattcaatttttaaatttcttttaaaccctgtgaattagacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcatttaccttcgtggttgagactgctgtctgtatgtctgggaatggaagtcctcttcagggattcagcaagggctgtacttttgcttaatactagtggttccttattctaagtgatgacatcatccacctttcctagaaatgggtctttgtgcctagtatgatatctttccaagaaaaagaatttggattttctattaaattagaaactcaattcacattatatatagtttgag

SEQ ID NO: 7279 - DNA, 4987 bp, Homo sapiens
  ENST00000508989
actgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtccttcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcattt

SEQ ID NO: 7280 - DNA, 742 bp, Homo sapiens
  ENST00000511489
acagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagtacagcctttccagcagagccagcctctattggaaactacttgatcattcatacaagcacatcagtgcacaagttccactgcccctcggtgatatagtagtagtagtcatgttcacggctcgttataaaacgtcatgttctgaagcatccatgtttaaagtgtcctctccagtaatttcaagtatcagcaatgagaaacacttattaaatattagtaac

SEQ ID NO: 7281 - DNA, 1947 bp, Homo sapiens
  ENST00000502468
gcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagtccatgtggataaagcacaagcaggagccagatgtccttgcgtgatcctcccttccagactataccttcgttaacattccttgagctagttattctttcctggcttacatgggaggcagaaaaagaacatcattgtattggaaagtttcccttaaatggctctttatgtggcagatagttgtttgcaatttagtttgaagagttttcagctttgttccattaacacagcattttgttgtttgagacttgtgacaacaaatatatttatttaggctcatgaaactcataaaagttgttggcacagtctcctctgctgctgttccaactctgcttagataaaccatggaaaataaactttctgtactaaactgaaaa

SEQ ID NO: 7282 - DNA, 1977 bp, Homo sapiens
  ENST00000514742
gcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaaggtgagtctctctactttgggaagcatgcctaattgtgactttaatgcaagaaaaacaggacttcatttgaaattttgaagactactggtcacaattaaaactctttatctactatgaaagcataggtttaagcctagagtagttctgtgtttgtgtattgtagccttagtgggtttgatttgaaaagagtcaatgagcatttgcatctagtttgttatctcagttgtgttgcattgagaatgggagtaatccagccatttatgtttcttcttaataaagtaggtttccatttcacttataaagttatatcaaaaacgaaaattgagatagaaataagaagtccaagtgaaatacagtatcatgtgtaaatgatgtgttagtagttggcaccgtgtcatatattat

SEQ ID NO: 7283 - DNA, 10724 bp, Homo sapiens
  ENST00000262464
ctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 7284 - DNA, 10154 bp, Homo sapiens
  ENST00000619499
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcacccaaccgtgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaa

SEQ ID NO: 7285 - DNA, 589 bp, Homo sapiens
  ENST00000495672
ttgggcggctgcggtctgcgcggacccccgtgcctaggcgctcctgtgcctccagtgcgcggagccggcctcgctcgggcgtgttcctgcgccgaccggacggccggactccagcaccttggcccggcccgcgaacgctgagcacgcgcggaaaccctttaaaggaagtgaaatcaaatggaggttggtgagtaccccacggcaaccattgcttcgtttcatggttcagagtgaactctaatctggaagccttccttaggtcattcctgcttctgggatccaactctatgttgtgcttaagaaatgtgtcacatcagacagagtgaatcacaagacagagatatttacctatcacataaatattttattagatttcaagatgaccatatatacttggacgtatctggacttcaaatttgctggaacttaattgcgtcccaagctggctaatacctagagattcatcatttctgtttggaggaatgaagaggaacagtttatctgttgagaataaaattgtccagttgtcaggagcagcgaaacagccaaaagttgggttctactcttctctcaaccagactcatacaca

SEQ ID NO: 7286 - DNA, 2693 bp, Homo sapiens
  ENST00000635168
tgggcggctgcggtctgcgcggacccccgtgcctaggcgctcctgtgcctccagtgcgcggagccggcctcgctcgggcgtgttcctgcgccgaccggacggccggactccagcaccttggcccggcccgcgaacgctgagcacgcgcggaaaccctttaaagataggaagtgaaatcaaatggaggttggtgagtaccccacggcaaccattgcttcgtttcatggttcagagtgaactctaatctggaagccttccttaggtcattcctgcttctgggatccaactctatgttgtgcttaagaaatgtgtcacatcagacagagtgaatcacaagacagagatatttacctatcacataaatattttattagatttcaagatgaccatatatacttggacgtatctggacttcaaatttgctggaacttaattgcgtcccaagctggctaatacctagagattcatcatttctgtttggaggaatgaagaggaacagtttatctgttgagaataaaattgtccagttgtcaggagcagcgaaacagccaaaagttgggttctactcttctctcaaccagactcatacacacacggttcttctagactgggggagtttgcctcaccatgtagtattacaaatttttcagtaacttcctttactagatcgggcctgtgcatcttctgtatgtaggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggaggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctggtaatgggctgccaaagattctgaaattgttgttgttgtttttttaatcagtatgattagctgctttctatctaagcaaatgtaaattttaaaatgtgttgctgctgtattttaggtcaaatatttgattgtttgcaaactgtcgtgatggattgctgcagaaacatttggaaaaaaataagaaatttgaaaagcaagaaattgctgtaaatagggcacaagccctgtatatggattagatggtcgatatgccaaaaactacagatggtttctaagtagatttctcacctttccttggaggcatattgtagcttgctaagtaagtgtgtaatattgaacttggattctgtaaagttatgtcatttgctttattacattgttttatttgattctattttatcttggtattaatatattttataaaatataaaatattttaaagcttatttaactataacatttttagcaccctatgagatcatcttgtgattcagtaaaaaacttctaatttccaaagtacttcagattctactttattatattgagagataatggacattcgattaaaatttaaaaatactaattcatttcataatgatactgaggtgaaaagacaagagatagtcattctgattgttagttggtagactatttgaataaagcagtaaatgttgcaggatgtgtttgggagggaatcagcatttgctgcctcctgctatggatctggaactgtgccagatcctttgtataagtgatcttagaatttaattagcaacacagttagaactccttagtggctgcttattgtcttgagggtgaagatctagccttaaaataacccacaaggtcctgcaaggtctggtccctccctgcttcttttgcctcatttcccatcaagctgccccttgcccttcagttcccatttcctctcagttccttagaactgtcctgcaccctctagtcacaaggaattcactcgtatctctctttgcctggcttactctctgtgctcctcagatctttcctctagctgtatgtccttgatcatggaagccttcctggacacccagcccattccc

SEQ ID NO: 7287 - DNA, 611 bp, Homo sapiens
  ENST00000475169
gcggacccccgtgcctaggcgctcctgtgcctccagtgcgcggagccggcctcgctcgggcgtgttcctgcgccgaccggacggccggactccagcaccttggcccggcccgcgaacgctgagcacgcgcggaaaccctttaaagataggaagtgaaatcaaatggaggttggtgagtaccccacggcaaccattgcttcgtttcatggttcagagtgaactctaatctggaagccttccttaggtcattcctgcttctgggatccaactctatgttgtgcttaagaaatgtgtcacatcagacagagtgaatcacaagacagagatatttacctatcacataaatattttattagatttcaagaatgaagaggaacagtttatctgttgagaataaaattgtccagttgtcaggagcagcgaaacagccaaaagttgggttctactcttctctcaaccagactcatacacacacggttcttctagactgggggagtttgcctcaccatgtagtattacaaatttttcagtaacttcctttactagatcgggcctgtgcatcttctgtatgtaggaggtggaatgaagtttttcatatttctgacctttgg

SEQ ID NO: 7288 - DNA, 768 bp, Homo sapiens
  ENST00000472159
ctgcgccgaccggacggccggactccagcaccttggcccggcccgcgaacgctgagcacgcgcggaaaccctttaaagataggaagtgaaatcaaatggaggttggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatgatgggttacattttttaaagctagaatgatatgatatttttattacaataactataaagatgcaatttccttttgaaaattatatacctatgaagcataaattatttaagttttttcaaaagatttcttaatctgcaaggtaggtatagttatagtaagtttctcctgagatattttaattttacatatatacatatgcttttcattatat

SEQ ID NO: 7289 - DNA, 1742 bp, Homo sapiens
  ENST00000467490
ctgcgccgaccggacggccggactccagcaccttggcccggcccgcgaacgctgagcacgcgcggaaaccctttaaagataggaagtgaaatcaaatggaggttggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatgatgggttacattttttaaagctagaatgatatgatatttttattacaataactataaagatgcaatttccttttgaaaattatatacctatgaagcataaattatttaagttttttcaaaagatttcttaatctgcaaggtaggtatagttatagtaagtttctcctgagatattttaattttacatatatacatatgcttttcattatatacataatacctcctggcagccatgctctcagaagttgttattagatagctattttcacaaataatgaataattaatattaaatttaaatttacaaaatattatattaggatcagtatgattctttgttcttgagaatttttcccaacttcccacaggaattctttgtgtagctgaccgttgtcaaggccttagagaactggcgttgaattattacatcctaactgatgaacttttccttgcactctcaagcgagactcatgttaaccttgaacatcttcgaattgatgttgtcaaatatttgattgtttgcaaactgtcgtgatggattgctgcagaaacatttggaaaaaaataagaaatttgaaaagcaagaaattgctgtaaatagggcacaagccctgtatatggattagatggtcgatatgccaaaaactacagatggtttctaagtagatttctcacctttccttggaggcatattgtagcttgctaagttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagatgtccacaccctggtgaggcctctgacttctaggatgtaaataagaacgaacagactgaggaactgccttaggggagctttactgcctgggaacatggtgttagcccactgtttgcagacgaggtaccaaagcttgaagctgccagaacatgttgggatgtcccaggatgcctcactctgtttagcccaattttaacctccctccccgcaggtgctaataaccatatcataaagatgaaagcatttaaaatg

SEQ ID NO: 7290 - DNA, 1305 bp, Homo sapiens
  ENST00000297158
atgaagaggaacagtttatctgttgagaataaaattgtccagttgtcaggagcagcgaaacagccaaaagttgggttctactcttctctcaaccagactcatacacacacggttcttctagactgggggagtttgcctcaccatgtagtattacaaatttttcagtaacttcctttactagatcgggcctgtgcatcttctgtatgtaggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctggtaa

SEQ ID NO: 7291 - DNA, 1479 bp, Homo sapiens
  ENST00000478939
tgtatgtaggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatgatgggttacattttttaaagctagaatgatatgatatttttattacaataactataaagatgcaatttccttttgaaaattatatacctatgaagcataaattatttaagttttttcaaaagatttcttaatctgcaaggtaggtatagttatagtaagtttctcctgagatattttaattttacatatatacatatgcttttcattatatacataatacctcctggcagccatgctctcagaagttgttattagatagctattttcacaaataatgaataattaatattaaatttaaatttacaaaatattatattaggatcagtatgattctttgttcttgagaatttttcccaacttcccacaggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctggtaatgggctg

SEQ ID NO: 7292 - DNA, 724 bp, Homo sapiens
  ENST00000498734
ttattttggtcgttcagtcagcaaagtggttttaggacgggtcaaatatttgattgtttgcaaactgtcgtgatggattgctgcagaaacatttggaaaaaaataagaaatttgaaaagcaagaaattgctgtaaatagggcacaagccctgtatatggattagatggtcgatatgccaaaaactacagatggtttctaagtagatttctcacctttccttggaggcatattgtagcttgctaaattgttaagcaaaaccacatgggccacaggaaggaatgcctccaatcagctgtggggtttcgtgaagtgtgtgcatgaagcagaagttttcagagaaaatggtgaaacgtccttgaaagtgcctcagctgggagaggatcagaaaaaaatatctatcgggttttatcattttgaaagaagtacaaaatctctacgtatggaacctgcattaaataaatgagcatcaacatctccaggaggcaccccaggtgtagactccacctctcttacctcttccagatattcgaacaccattattgatagcattcttgttttgataaggtttctcctggcccacaatcattccagtgaatggtgcgtacacagtagatccagcagagcacaagatgtccacaccctggtgaggcctctgacttctaggatgtaaataagaacgaacagactgaggaactgccttaggggagctttactgcctgggaa

SEQ ID NO: 7293 - DNA, 598 bp, Homo sapiens
  ENST00000461079
tcctttgcaagatggcccctccccgccacctcaggattcttcctactatcaccccagggagcctagtccaagggagatcagggacccaagactaggcgacacgcagcgaagacactcagaaagagatgggagacgggaggggaaggctcaaggcagtccgggcagcaaggcactgatgcttttcgtctgcttggagggcgaggagagatggagggcaggtgttgcagagcaggcgagatcagtggggaggtttcgactggttctccccagaagagggaagaggatgtgtgccagtgccggcctgagtgttcccaggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaact

SEQ ID NO: 7294 - DNA, 543 bp, Homo sapiens
  ENST00000498195
aggaaggaggaggaggaatctcagataagccggttggggataataggcggaagagctcagggagaaaagagtgaggggaggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggcc

SEQ ID NO: 7295 - DNA, 2276 bp, Homo sapiens
  ENST00000241071
gagagaagggaggggaacaaggatagagcgctcgccaacggccgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctg

SEQ ID NO: 7296 - DNA, 1630 bp, Homo sapiens
  ENST00000488079
cgacgctccaggccgtcccgcccagcgcagctgcacccaatcacaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtgaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgag

SEQ ID NO: 7297 - DNA, 1330 bp, Homo sapiens
  ENST00000474649
acaatgctcagatcgggaggtggagccaatcaggtccaaccaagaggaggggacaccggcactccactagcaggaaaacgggccgagggaccgcaagcagggggtgcctagtcctcgtcccccaaagaccaatcgtaagccagatacaggcgagtgactgtcaagaaggccaattagagcctccgaagggaatctggacctgcctcttctctgagggacggctctacctaccaatagcatgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggatgtgagtagcagaaccctggcagctgagagcccacctgtattagtccattttcacactgctataaagacgtaccagaggccgggtgcagtggcttacacctgtaatcctagcactttgggaggctgaggcaggcggatcagctgagaccaggagttcgagaccagcctggccaaatggcgaaacccgtctctactaaaaatacaaaaattagctgggtgtggtggtgggtgcctataattccagctacttgggaggctgaggcaggagaattgcttgaacttgggaggcagaggctgcagtgagctgagatcgcacccttgcactccagcctgggcaacaagagggagactccgtctcgaaaaaaaaagacatacctgagaccggtttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttc

SEQ ID NO: 7298 - DNA, 957 bp, Homo sapiens
  ENST00000465843
atgggcgagaaggcggtccctttgctaaggaggaggcgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcaggacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagatcctattctgtgctcttggctacaaccaccttggcctggtggatga

SEQ ID NO: 7299 - DNA, 579 bp, Homo sapiens
  ENST00000466053
aagactgaggttaagaatgaacgcggagcccctggccggccgggaacgcagttcgccgctgcagtggcgagtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtgg

SEQ ID NO: 7300 - DNA, 1901 bp, Homo sapiens
  ENST00000468962
agactccatgggggaggggcctaggaggcagaggggcctcagaggtcccccaagcctaggctggggacatggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagg

SEQ ID NO: 7301 - DNA, 2087 bp, Homo sapiens
  ENST00000427939
taggctggggacatggtgtgggaaagccagcaggaacgggggggccaagggcctaggagacaggagggcaggagcagggagggggcaatcaggatggtcaggggaagccagagacggaagctgcaaaaattcaccaggctgtgtggacgggaggaggggctccgggtgaagagaagctgcccttcttgtggctcggagcttggggttgaagagaagagggggaaaggaaatccgatttccatccagttgttccccccagagctggtggagcatatcatctcattcctcccagtcagagaccttgttgccctcggccagacctgccgctacttccacgaagtgtgcgatggggaaggcgtgtggagacgcatctgtcgcagactcagtccgcgcctccaagatcagggttctggagtccggccctggaagagagctgccattctgaactacacgaagggcctgtatttccaggcatttggaggccgccgccgatgtctcagcaagagcgtggcccccttgctagcccacggctaccgccgcttcttgcccaccaaggatcacgtcttcattcttgactacgtggggaccctcttcttcctcaaaaatgccctggtctccaccctcggccagatgcagtggaagcgggcctgtcgctatgttgtgttgtgtcgtggagccaaggattttgcctcggacccaaggtgtgacacagtttaccgtaaatacctctacgtcttggccactcgggagccgcaggaagtggtgggtaccaccagcagccgggcctgtgactgtgttgaggtctatctgcagtctagtgggcagcgggtcttcaagatgacattccaccactcaatgaccttcaagcagatcgtgctggttggtcaggagacccagcgggctctactgctcctcacagaggaaggaaagatctactctttggtagtgaatgagacccagcttgaccagccacgctcctacacggttcagctggccctgaggaaggtgtcccactacctgcctcacctgcgcgtggcctgcatgacttccaaccagagcagcaccctctacgtcacagaccaggggggagtgtattttgaggtgcataccccaggggtgtatcgcgatctctttgggacccttcaagcctttgaccccctggaccagcagatgccgcttgctctctcactgcctgccaagatcctattctgtgctcttggctacaaccaccttggcctggtggatgaatttggccgaatcttcatgcaaggaaataacagatacgggcagctaggaacaggggacaaaatggaccgaggggaacccacacaggtttgttacctgcagcggcccatcaccctgtggtgcggcctcaaccactccctggtgctgagccagagctcagagttcagcaaggagctgctgggctgcggctgtggggctgggggccgcctcccaggctggcccaaggggagtgcctccttcgtcaagctccaagtcaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgag

SEQ ID NO: 7302 - DNA, 6744 bp, Homo sapiens
  ENST00000517956
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggattgcttgagcccaggagtctgaggtttgcagtgagctatgattgtgccactgcactccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctgagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggaatagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgagctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 7303 - DNA, 735 bp, Homo sapiens
  ENST00000524000
tgaatcgctgctctctggcccccccacctattgtcacccttctctctgcagcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataa

SEQ ID NO: 7304 - DNA, 1197 bp, Homo sapiens
  ENST00000287396
gggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgcca

SEQ ID NO: 7305 - DNA, 1227 bp, Homo sapiens
  ENST00000443022
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaac

SEQ ID NO: 7306 - DNA, 938 bp, Homo sapiens
  ENST00000521719
caacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaaggtgagccttctctcactctctcgcccctttttataggcatggaggtgggcagatggattttccaatgaagtggacgtgtcattagacttaaagacatgtgaatggatggaaatgaataactccagctacattttagagacactaaattccagttcggaaaggggtacaactcatcctcatggcaaaggtccttgaagaccagcaaaacattagactaataagggaactactccagaccctctacacatccttatgtacactggtccaaagagtcggcaagtctgtgctggtcgggaa

SEQ ID NO: 7307 - DNA, 807 bp, Homo sapiens
  ENST00000520511
gcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccgggccctgccactagccagtgagggaaatagatgaaatagatctgactctaccttgaaggtctgcagcaggggtcagcaaacttctagccctcaggtcaatagcctgccgcctgtttttgtatggcccatgagctaagaatgatttgtacgtttttcaatgttttaaaaaattgaaaggagtataatgtttcataacacatggaaattatgtgcagctcaaatttcagtatccataaataaagttttattggaacacagct

SEQ ID NO: 7308 - DNA, 1932 bp, Homo sapiens
  ENST00000487794
ggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggtacacccctgccgccatgctgcccgcctcggtcctaggagcttgggggaggccgggcaggggtcctgaggggcagacagcaagcaagtccacaggcaaagctgggatcgttcactcgcccctggggtcacaagcccagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 7309 - DNA, 2274 bp, Homo sapiens
  ENST00000325285
ggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 7310 - DNA, 2392 bp, Homo sapiens
  ENST00000483559
cgttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggtgcgtgcggggctaggggcggggctgccctcctggggcctggcgcccggcgcccacctggcacgtgcccccgcccccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 7311 - DNA, 2339 bp, Homo sapiens
  ENST00000459905
gggctccccgttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctaggtgagcacgggcggcgggttgaccctgcccccgccccacgccgacagcctgtccagccccggcctccccacagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 7312 - DNA, 1442 bp, Homo sapiens
  ENST00000480818
ggcctcccttcccgggcctgggctgagggcagccgttggtgggtttcagggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctaggtgagcacgggcggcgggttgaccctgcccccgccccacgccgacagcctgtccagccccggcctccccacagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgacc

SEQ ID NO: 7313 - DNA, 785 bp, Homo sapiens
  ENST00000491246
gcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagtagcaggcccccgccccgcgacctggccaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccag

SEQ ID NO: 7314 - DNA, 718 bp, Homo sapiens
  ENST00000428398
gttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacg

SEQ ID NO: 7315 - DNA, 839 bp, Homo sapiens
  ENST00000443788
gtgcaggagccccgaggccgcccgtgcgctcgtccccgccgtccgccccgagcccgccgggcagagctgctccagggccgcagggcggaggccactgcctggccgccccgagcttcctctcggcggaagcccgtccccggacggcgcctggtgtccccgtgcctcgcgtgcggcggtccgggccctggcgggctgaggggcgcccgctgccggccgcaggaggccgggggatgacgcggcggagaggggccggcccggcccgcccggagctgccgggtccttggttgggcggcggtacccgggcgtcccctgcagacacgcagccccgtggaactcccggcgggacggttggggctggaggaacaggacgcccgctctcggcctcccttcccgggcctgggctgagggcagccgttggtgggtttcagggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcaca

SEQ ID NO: 7316 - DNA, 1581 bp, Homo sapiens
  ENST00000587296
agacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagggtgggtcactctgtctgtcgggctcccgagatcgcaacgtcaacttgtgggacctgcggcagctggggacggagtccaaccaggttctgatcaagaccttaggcactaagcgaaatagtacccatgagggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggagttggtggcggccgggatgcccacaaggaaggggtcattcttggcctgctccgtgcagaacttcagcagatcggcggccatctttggacacctgcagaccaactggttcagccagaccagacccaggcatgcacctgtcccctggcccatgtgttcccacctcttcccgcctcctgcactggccccgaccctcaccttcacttggtcgatgcctgcctccatctggagctgctccactgcccagagggcctgcccaatgtcactgttgatggccaccttgctgg

SEQ ID NO: 7317 - DNA, 1738 bp, Homo sapiens
  ENST00000393261
ggaagtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 7318 - DNA, 1437 bp, Homo sapiens
  ENST00000587955
atggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagacaggatggagacccgggatgctctcatgggctggggggggccttcgaggggctctgatatccctcctcaccggcccatcacccatgaagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctga

SEQ ID NO: 7319 - DNA, 1910 bp, Homo sapiens
  ENST00000597312
tgggtgcacctgctgtgtagctcaagtgtgatgggctctggagtgccccacttctgatctcaggctgctatctctccacaccagctgtgtctccctgctaaccacgctaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcgtgaggacacccccagctccatgtggtccccccaactcatggggcccttctgtgttccctccttcacccccatctcagagctgggggagcccaacgcatcctctcaaaacccaattttcccatcctgcctcccatcttgccactgccagccctttcccatcccccaccctccagagcccctcaccccacacccagcatccctgtcctccacactttcagcacctccatggcttatacccaagacctccatccccagctgggaggtggggtgcaggcaggtgggggcactgacaatcccccctctccactcctcttctctccccctccccagactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccaca

SEQ ID NO: 7320 - DNA, 1596 bp, Homo sapiens
  ENST00000346664
agtggctctactttcagaagaaagtgtctctcttcctgcttaaacctctgtctctgacggtccctgccaatcgctctggtcgaccccaacacactaggaggacagacacaggctccaaactccactaaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctccca

SEQ ID NO: 7321 - DNA, 1560 bp, Homo sapiens
  ENST00000597921
ctgcttaaacctctgtctctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcc

SEQ ID NO: 7322 - DNA, 1872 bp, Homo sapiens
  ENST00000598803
ctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcgtgaggacacccccagctccatgtggtccccccaactcatggggcccttctgtgttccctccttcacccccatctcagagctgggggagcccaacgcatcctctcaaaacccaattttcccatcctgcctcccatcttgccactgccagccctttcccatcccccaccctccagagcccctcaccccacacccagcatccctgtcctccacactttcagcacctccatggcttatacccaagacctccatccccagctgggaggtggggtgcaggcaggtgggggcactgacaatcccccctctccactcctcttctctccccctccccagactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggc

SEQ ID NO: 7323 - DNA, 1577 bp, Homo sapiens
  ENST00000597934
agaagaaagtgtctctcttcctgcttaaacctctgtctctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcagggtgagagactgggatcggggttatgaagccagattgggtgggaaggagggagtgtctcagagccctggggaaccacgaggctggggggccaggcttggggggcaccctcggcctgtacacatcctccctgagaccagccctgcgctcctgcacacaccagacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatg

SEQ ID NO: 7324 - DNA, 801 bp, Homo sapiens
  ENST00000593418
atgggtgcacctgctgtgtagctcaagtgtgatgggctctggagtgccccacttctgatctcaggctgctatctctccacaccagctgtgtctccctgctaaccacgctagtgagtccagattgtagactaaacaaaatcagcaaatggcccctgagtgccaccaagtcccagatgctatcctgtgctggtaactaggatttgatggctcaccctaaccatcattaaatcccaaatcagccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggc

SEQ ID NO: 7325 - DNA, 1482 bp, Homo sapiens
  ENST00000360067
aacggcttcagctagggagcggggagcccaatagagtcagaggccaaatagaacaggaacttggaacaagcagaatttagcataatgaatcctccaagccaggagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtccccttcttgg

SEQ ID NO: 7326 - DNA, 4340 bp, Homo sapiens
  ENST00000311172
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 7327 - DNA, 4509 bp, Homo sapiens
  ENST00000409314
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagtttaaaagccgcccaactggtggatattgagctctcccctgtcagtgctctgagaatgaccatagctgagagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatt

SEQ ID NO: 7328 - DNA, 3154 bp, Homo sapiens
  ENST00000409418
ggcggcgcaggcggccgaccgggagcgcggacaacgcggctgcggctaacccgccgcccggccggctgagaccctcgcgcccctgctcctggggcccccgccccctcgccgtctccgcctccttcctcacacacccccgggccgcccgggccgcccgggccccaagccttcccggtgctcctccctcgtctcctcacactcgctctctggctggggtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaa

SEQ ID NO: 7329 - DNA, 932 bp, Homo sapiens
  ENST00000409263
tgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaaga

SEQ ID NO: 7330 - DNA, 2215 bp, Homo sapiens
  ENST00000458644
gctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacagtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagtttaaaagccgcccaactggtggatattgagctctcccctgtcagtgctctgagaatgaccatagctgagagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctac

SEQ ID NO: 7331 - DNA, 1867 bp, Homo sapiens
  ENST00000409853
aagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaact

SEQ ID NO: 7332 - DNA, 578 bp, Homo sapiens
  ENST00000432043
ggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgcttt

SEQ ID NO: 7333 - DNA, 321 bp, Homo sapiens
  ENST00000543644
ctgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggtgcggcaaacatttgttatctagtggttattgatgtagaagatacaagagtgatgtaagaaataaaataatgactcaaactgggaaa

SEQ ID NO: 7334 - DNA, 587 bp, Homo sapiens
  ENST00000422375
tagtcaccgcctccccaccccaagggaaaacaaattaaggattgacgggtcctgcctcgtccccggctgaggggcgaggaggctgtcgtgctgtcttcagaaaagcgaggaccgggcccgggaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatgg

SEQ ID NO: 7335 - DNA, 741 bp, Homo sapiens
  ENST00000530337
ggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatg

SEQ ID NO: 7336 - DNA, 2176 bp, Homo sapiens
  ENST00000220584
aatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagta

SEQ ID NO: 7337 - DNA, 1558 bp, Homo sapiens
  ENST00000446331
gcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagca

SEQ ID NO: 7338 - DNA, 1393 bp, Homo sapiens
  ENST00000443614
tcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaa

SEQ ID NO: 7339 - DNA, 898 bp, Homo sapiens
  ENST00000525283
gaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaa

SEQ ID NO: 7340 - DNA, 1773 bp, Homo sapiens
  ENST00000525607
gaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgc

SEQ ID NO: 7341 - DNA, 932 bp, Homo sapiens
  ENST00000529464
acctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtga

SEQ ID NO: 7342 - DNA, 1596 bp, Homo sapiens
  ENST00000525900
cggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcat

SEQ ID NO: 7343 - DNA, 810 bp, Homo sapiens
  ENST00000525571
gccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccgataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtcccca

SEQ ID NO: 7344 - DNA, 642 bp, Homo sapiens
  ENST00000527045
ggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatt

SEQ ID NO: 7345 - DNA, 2013 bp, Homo sapiens
  ENST00000528812
atctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttg

SEQ ID NO: 7346 - DNA, 327 bp, Homo sapiens
  ENST00000525551
cgggtggacgcggccgtcctggctgacctgtccctgcccccgcaagccgccctgggcatgagcgacttttgcgtggttcccggtggttgcgctccccgtttcgtcccctccgtgagcatcggcgcttaccgcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattag

SEQ ID NO: 7347 - DNA, 1761 bp, Homo sapiens
  ENST00000530664
aattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttcccttagcggccagtgggttctggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgct

SEQ ID NO: 7348 - DNA, 1890 bp, Homo sapiens
  ENST00000525954
gcgtattcgagtagagggcgagcccgtcccgcccctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcacc

SEQ ID NO: 7349 - DNA, 712 bp, Homo sapiens
  ENST00000531733
gaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgaggg

SEQ ID NO: 7350 - DNA, 768 bp, Homo sapiens
  ENST00000531249
cgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagacc

SEQ ID NO: 7351 - DNA, 583 bp, Homo sapiens
  ENST00000532266
caggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttagggga

SEQ ID NO: 7352 - DNA, 1909 bp, Homo sapiens
  ENST00000528643
cttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaaga

SEQ ID NO: 7353 - DNA, 1472 bp, Homo sapiens
  ENST00000525777
gcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatccc

SEQ ID NO: 7354 - DNA, 570 bp, Homo sapiens
  ENST00000528729
aataccaaacagtgattgccgacatttgccggagaatgggcattgggatggcagagtttttggataagcatgtgacctctgaacaggagtgggacaagtgctttaaaaatcgtctcttacagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggc

SEQ ID NO: 7355 - DNA, 418 bp, Homo sapiens
  ENST00000529521
gctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagac

SEQ ID NO: 7356 - DNA, 2368 bp, Homo sapiens
  ENST00000623368
aatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 7357 - DNA, 2289 bp, Homo sapiens
  ENST00000538689
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 7358 - DNA, 2660 bp, Homo sapiens
  ENST00000618539
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 7359 - DNA, 2462 bp, Homo sapiens
  ENST00000615631
aaaaacggtggcaacacgctgggtttgctttacaacgcttgggaagctttgttgtttgcaataaattttaatacttgtctgtttcggtctgcactgcctttatgagctgtaacactcacagggtaggtttgcagcttcactcctgaagccagtaagacaacgaacccactgggagaaacaaacaactccagacgcgccgacttaagagctgtaatactcgctgtgacggtctgcagcttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 7360 - DNA, 1987 bp, Homo sapiens
  ENST00000622850
agggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtc

SEQ ID NO: 7361 - DNA, 5816 bp, Homo sapiens
  ENST00000274457
ccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcaccaaa

SEQ ID NO: 7362 - DNA, 3322 bp, Homo sapiens
  ENST00000478194
aaaggaaacacaagttgcttttgataacacatgatgcaaagaaagaattagaaagaatgagcaatgaagccggtataaatgacaaacaagtgtccaaaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtatatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttga

SEQ ID NO: 7363 - DNA, 5151 bp, Homo sapiens
  ENST00000217289
ctggagtctcccctggtcgggagcctcagccttctggagactgacaccaccctcttactcagagacgaatcgttttgtcgttgccttcacctccctgaccacaagtgctccggggctctttctgagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtatatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttga

SEQ ID NO: 7364 - DNA, 567 bp, Homo sapiens
  ENST00000378844
ccagttaccccctgaaacatttcagttgtgaacgttctttcctgctagcttctcccatgaggggaaaacgatgggtttgaaattcacatccctatctgtactttgaagaacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaa

SEQ ID NO: 7365 - DNA, 3229 bp, Homo sapiens
  ENST00000536936
agtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctc

SEQ ID NO: 7366 - DNA, 2001 bp, Homo sapiens
  ENST00000486811
gatgggaccttctcaattatacaaacatgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaa

SEQ ID NO: 7367 - DNA, 2074 bp, Homo sapiens
  ENST00000283268
cttttaaagtttgaggggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaaca

SEQ ID NO: 7368 - DNA, 1918 bp, Homo sapiens
  ENST00000475839
cctgttcatttgaatgcaaatgggtgacccgggcccgactaggtgcttattaaattgcagttttcccccctgccttttccggaatgcagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactc

SEQ ID NO: 7369 - DNA, 3321 bp, Homo sapiens
  ENST00000375482
tgcctgtgggtgccgcggaccttcggggcgggccagggaggcgggaccgctcctcagaaccccaggggcttcagtcctgggctgattggcgcgggaagcacagcccggccctccaggtccccaaggagaccccagcctcctgctgcccactgtgagcgacctccccggggctcctctggaagcggctccggcaagtatcgagtttgcctgtgcggagctgggggagcctccggctttcctgtttgctttgttaattattttcgtccccagaggaaggcgtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 7370 - DNA, 918 bp, Homo sapiens
  ENST00000468206
tgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccag

SEQ ID NO: 7371 - DNA, 915 bp, Homo sapiens
  ENST00000494669
gtgtggtgggggtgctccaccatagagctggtcggcatccacagccaccaggacgctgccagagcccaggcctgcgccacgccctgcccagaggcacacctgcctgctcaaggcaaccagggcaggctcaaggcagccagggccagctcactgtgtgcctgtcactgtgtgaagcctgcttcttctttatttcgcttagcaagtgaggcaggagcatgtaaagctgctggcagaggaatatctaatttacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggccc

SEQ ID NO: 7372 - DNA, 4697 bp, Homo sapiens
  ENST00000467786
ggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctccagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgacttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 7373 - DNA, 244 bp, Homo sapiens
  ENST00000494553
aaggatcccatgtgagaagctcactggggcccctggggggacctgcgggcagctctcgttcctcacctgtgccatccctcttgcagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccct

SEQ ID NO: 7374 - DNA, 462 bp, Homo sapiens
  ENST00000488407
ctcgagcccagaaaactatcctctaagaccagacgtgacaaggagaagcagagctgtaagagctgtggtgagaccttcaactccatcaccaagaggaggcatcactgcaagctgtgtggggcgccatgctgaggggtgagaggtggtttctggttatgaatttgatttgcgtttccctgatggccagtgatggggcatcttcccctgtgcttggtggctcttcacactcttcctcccacgcacacaagactcctggactctggaccctccaggacagaagggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcg

SEQ ID NO: 7375 - DNA, 3432 bp, Homo sapiens
  ENST00000416701
attccctgctgggcccctcctccctgaagatctacacagcagatctactcacaaaagtccacccagcagaagcaggaggatggtggttgtgggtcctctgtgagcagccctgttaacctttaaaccagcacggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 7376 - DNA, 3303 bp, Homo sapiens
  ENST00000337352
gagcactcaggagactgtgtgtggtgggggtgctccaccatagagctggtcggcatccacagccaccaggacgctgccagagcccaggcctgcgccacgccctgcccagaggcacacctgcctgctcaaggcaaccagggcaggctcaaggcagccagggccagctcactgtgtgcctgtcactgtgtgaagcctgcttcttctttatttcgcttagcaagtgaggcaggagcatgtaaagctgctggcagaggaatatctaatttacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 7377 - DNA, 2977 bp, Homo sapiens
  ENST00000534526
ggtagcggctttgagtgagtgcgggagctgcagataccgagacgctgcgactgccgcaggagtcgccgcagccaaactcgccgcgacgccgggagggagcgtaccgggaaggagagggagaggaggcactcgctgaggagacgccgcagtagagggcgcccccggagtcgcgccgaacctgggcatgcaggcgacgccccccaggggccgctcgcggctggacgggagcgggaggagtcggggagcggcggtcgagcccggcaggatgagcgacgagggcggctccaacttcaggcgggtggcgatccggcggaagtccaacccctcctacctgccgcccggggtgccccggccctggagcaggcccgcgtcgcacctgggacgtgtagggaccgctgccttcaagggccaggtgccctcaggagccacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctga

SEQ ID NO: 7378 - DNA, 549 bp, Homo sapiens
  ENST00000550091
ctacctgccgcccggggtgccccggccctggagcaggcccgcgtcgcacctgggacgtgtagggaccgctgccttcaagggccaggtgccctcaggagccacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtg

SEQ ID NO: 7379 - DNA, 2924 bp, Homo sapiens
  ENST00000531134
agttagttctttatcatgttgaacactagatgtgtatgtgtctagtgtctaaatacagaatgcctatagtttctaccaacaaattatggatccaaatccttgctccagaagcaggaaataggttaatcagaagattgctggatgttatgaaaagaatcttttatggggggctgcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtg

SEQ ID NO: 7380 - DNA, 1629 bp, Homo sapiens
  ENST00000472289
ggagcacaaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtattaaattattcaacagattataa

SEQ ID NO: 7381 - DNA, 1439 bp, Homo sapiens
  ENST00000494275
caaagacagcgattgttacccaataagcagtagtcacacacttctaccaatcgccttaggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtattaaattattcaacagattataa

SEQ ID NO: 7382 - DNA, 537 bp, Homo sapiens
  ENST00000497153
accatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagatctaggccagtgagcatgagccaactgtcagctaactgagtttataaaagagatgagatcactaaaaaccaggggaaccagctgggggaaaatgaggcatgtaattaggaggcgacatgactcctcacccttcttccagaagtgcctccaaagccattacacctgcagaattcac

SEQ ID NO: 7383 - DNA, 2987 bp, Homo sapiens
  ENST00000493087
atctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaaacctttctcattacagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgca

SEQ ID NO: 7384 - DNA, 2435 bp, Homo sapiens
  ENST00000551984
gtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactgga

SEQ ID NO: 7385 - DNA, 8242 bp, Homo sapiens
  ENST00000427716
attatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctcttttttaatggccagcggggtatgtgtgtgatgtatactcagagtggttttttggaaaattaaactgtagctatagatgatgctttggttttcttaatctcaagaaaagagaagcaatggaaatacagaatgattaactggggaagaggacttttgtaagtgtgactagaacaatggtaatgtatgggccaatgggaagatttataagtcagattatttttgaaaactatttttaaaagcaagaagactacactttccctaccaaaacagaagtaacatggacacacttaagttttggctcaataaatatcaatgttatttaacttagatcattgaaagaatactcatgtaaagataatgtttattatcatgctcttaacagtcattatctttaattttttaaatgagaagcattaatactagaagagaatttctggttatccggtcaccatattcactttccaccccacattcttcagctaaacgcaaagagaagcagtgaaacagccttacccgcttctctcttattaaagaatcactgatgtttttactcaatgaaaggtaaagtaatacccttagccatttattaaacaattcaaccaagagacctcaaagtgtgattgatgataagaataatcaatgccttttcccttccaacatacttgagcagtcatgacaacctaaaaatatcattggttgctttcccattaaaaccaacgttccctgtgggtcttaattctttattttcactcatttggtgctttccaagtcatcttttctttaaagtgcccttcctccaaactttaaaaagtacttccttgacaaaatttctattcattataaaacatttcaatattttaagcttaaattttgcttttgctgaaagcctaccatttggcgtgttaagtatgaaatatagtgcagacttttatcttggttttaagtggggctcaataaaaaacaccagccacttttgtaataatggcatcacagtgtcatcatgtatgcaagcaataaaactctttagggtatggttttatactgaaaatttaatatgaaggccccttcccacaagaatatagataattattaactttctagatgtgatacggtaattcgaattgcagagtataaggaagggaaatgggaaggggcatcattccttggattttaaataactatcaagaacatttttactttaacaaagaaaatggatagaaaaagcacattttgttttccctgaagtttaatttgacatcaggtttgtgtacttatcttcactaggtgacttaacttaccccaatttttttaaaaattattaaactttttacagaaactaaccttttaaatgtaccctttccccatatatatatacgcacacgtttggattttttttttttaagaacacttgttctagttataaatatataaagaaaacgataaagtttgtggtactgcagggttgttaaagattctttgatgccttctaaaaacttttgtcaaaaatacttttgagttcacaattctgttttacttttccttgtccttactttttggaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaatctgaagtcaatcatggtcttctactttctggactgagcatttggcagaatgcagtatcttttcctgtattttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacattttaaaataagcataggccgggcatagtggctcatgcctgtaatcccagcccttgggaggccgaggtgggcagatcacttcaggtcaggagtttgagaccagcctggccaacatggtgaaaccctgtctctactaaataaaaataaaacaaaataagtgtatctgggccaggcacggtagcccatgcctgtaatcccagcactttgggaggccgaggagttcgagaccagcctggccaacatggcaaaaccctgtctctacaaaaattagccaggtgtggtggcacatgcctgtaatcccagctactcgggaggttgaggcaggagaattgcttgaacccgggagacagaggttgcagtgagccgagattgcaccactgcactccggcctgggtgacagagcaagacttcgactcaaaaaataaaataagcgtatctggatttttcttttgaattcttgactgataagtttgagaatgtatgtttttggaattttacagttgactcaagtgtgaaagtatacacaagtaatttttcttttctagctatgtgaatgtaaaatacttgcagataatgtatatattgtgtaatatatgtatatttggtcataaaagcagataattggaaacattgtaaaattaagcactttaattcctattaaatattaaacatttgtatcttgtaaataaacacatccttaaattaa

SEQ ID NO: 7386 - DNA, 559 bp, Homo sapiens
  ENST00000473513
ttatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagaggatctgttgaggatctttccaccagggaatccagagactgat

SEQ ID NO: 7387 - DNA, 2691 bp, Homo sapiens
  ENST00000395740
ctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggtatctaaaccacatctgtctgaagggacagatgcccttgggggcaaggggaagcgagtggacagcggactcaaaatctgtagaacaagagttcaggcagtttcactgtttcattaaaattgaaaaataatgag

SEQ ID NO: 7388 - DNA, 535 bp, Homo sapiens
  ENST00000479023
gaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataagtgagatgagcatgaagcggtgcaaaacttagattgaacaagagagcaaagggaagcaaccatgaaaaagacagtctacagccataccacccggaatgtgctcaatctcatctaatctcagaaaaagacaaatttccacgaagagcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctag

SEQ ID NO: 7389 - DNA, 3503 bp, Homo sapiens
  ENST00000546442
ggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaa

SEQ ID NO: 7390 - DNA, 580 bp, Homo sapiens
  ENST00000583694
tatctgcaatggaccgggttaatgggaggcttgctttggctcgctggaagaacaaatgaagggagttttacttcaaccatttgtgacttctggccaagaggaataaattcagcttttataagatggagtctcactctgtcacctaggctggtgtgcagtggcacagtcttggctcactgcaacctccgcctcccggattcaagcaattctcccacctcagtctcctgagtagctgagattacaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggca

SEQ ID NO: 7391 - DNA, 2925 bp, Homo sapiens
  ENST00000525053
agtgcattggtctgagctcctggcagatcctgtgtaatcttcagcctccctgaagctttacagccaggagtgagattttatcacatgaactttaaaagagtaaagccaaatatctttttattaaaccagagtagattaattatcagtatatgtgaaatcatgtccactgatcaaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatg

SEQ ID NO: 7392 - DNA, 2349 bp, Homo sapiens
  ENST00000494977
gggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaagagacgaggttttgccatgctgcccaggctgatctcgaactcctgagctcaagcgatctgcctgcctcggtctcccaaagtgctgggattacaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagttccgcatggctggggaggcctcagaaaacgtacaatcatggcagaaggggaagaggcacatcttacatggtggcaagcgagagtgagcaagtgtatgaaggaagaactgtcagacacttacaaaaccatcagatctcatgagaactcacgatcacgagaacagcatgggggacactgcccccatgatccagttacctcctatcagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacagctaaacgcaaagagaagcagtgaaacagccttacccgcttctctcttattaaagaatcactgatgtttttactcaatgaaagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgct

SEQ ID NO: 7393 - DNA, 9288 bp, Homo sapiens
  ENST00000343958
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaacaatcttactggtggaaagtctttgtaaggaaaaaacacatagcaaggagcaaatttccacaaagtgcttggtttaggaattgtgattattataaaactgctgatgaaaaaaatgcatgtctttgaatcaataaacttgggtgaatatttgtatcttttagtggaaaaacatggccagcttctacctcagtaactgtgaactgaaatttcagtaaattatctaaagtatttctgttgttaggtacctctttggcaggagttaatattacatcatcaaagaattatagcaaagagatagaatctgaattttttaaaactgtgagtaggaatgaagatgtttttatttgcagaataccacaaataaccaactcttccggcttttaagtccaatcttttaaaaaatctaccacttcgaaacaaacataaatgtatcattttttaaaatagcaaaatatagcaagcattatgtcacataatattccctgctattataagagttctgagcccaagtcaatgatgatatttgtatctataagtaatgttacatttccaaaaatattgtgcattacaaatggaactggaattactatatcagaaaagcataattataagccagtaataactgaaattctatagtattcattttcaaaaggtctttttctgccagtttgtgatatcctccctcctaattaaaaaaaaaaacaacaaatcctttctctataagcagctatcagcacacctccttaggaaagatttagattcataattctggtgcacttactgtttaacatatgaactaccttgcacatacaattgttgattagcagaagaaaatgaaataacactgtgataaaagccatccctgatgttcacaatacacaatttattaactaagtttaaactataaattatcttaactgccatgagcggtggctcacacctacaatctcagcattttgggaggccgaggccgttggaccacctgaggtcaggagatcgagaccagcctggccaatatggtgaaaccccatctctattaaaaatacaagaattagccggtcgtggtggtacatggctgtagtcctagctattcagcaggctgaggcaggagcatcgcttgaacccaggaggcagaggttgcagtgagccgagatggtgccactgcactccagcctgggatgacagagcgagactccatctcaaaaaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtaccttataaactgtttctgcgtctggcatttagcaagacaagttatttgggttttctttccctcctcttgagctctcagccttctgactacaaggtttggcttaagccttataatctaaaaaatatcagccaggctattctatcttctaagacctggctgaatcatgagccagttctaaatctaaagagagtgagagagggaagaaatctggcacaaacttacagtctctttaattacatgtaaaatgcatgtgactgtattacctattggcttagccccatggagggtttagaaaaatgtgtagtctttgtggaagctatccaattatccttctcccaaaaagatgttttaaatgtggaatagtattacattcccctgcccctttatgagtccttcataacttactaaagctgaccaattgttatttatgtaacctggctcattcattgtcaactaagaacctaattatatgcaatttattgtaaaaaaagctataaaaatatattttgctagtattttagaggaaaaatgatattgggcacagtctataaatggggagaaaagttaagtagtatctagattccaaggatactatatttattatacagatatgtgtgcctgtgcttccatcaaaccctttttcaggtatctccttttaattcataaggaggaaagagtagggcatttataaagctaagctaaaaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaatccactttagtcaaatgtagtcaatgggatttccagagatacatattgtttttcttagtgtaccacacactccttgaaggcagatactgtacttaatatatcactgtcttccataatactgccctaggtctttttagtttttaagagaccgggtctcgctatgtttcccatgctgaactcaaatgcctgggcttaagcaatcctcccacctcagcctctggagtagctgggactacaggggcatgcaccaccaggcctggcttcctaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcctcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatatatactttataaataaaaaaattagcattgtaaataatgttaatatgtatttatacaaaataaatttactataatata

SEQ ID NO: 7394 - DNA, 725 bp, Homo sapiens
  ENST00000548069
ctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaa

SEQ ID NO: 7395 - DNA, 2232 bp, Homo sapiens
  ENST00000451107
gctctgcggggcggtgctagtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttca

SEQ ID NO: 7396 - DNA, 4568 bp, Homo sapiens
  ENST00000546711
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaattttccatattattaaaatgcaatttttgtgtgtg

SEQ ID NO: 7397 - DNA, 904 bp, Homo sapiens
  ENST00000551521
agttactggggcagctactggtttcctgttcctcccatctgactcagggtgatcagtcacattcttatgctgcagttaaggccccaggtgattcttaactgtttaaggagatccaggccctgctctctttgccaagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattag

SEQ ID NO: 7398 - DNA, 3757 bp, Homo sapiens
  ENST00000549499
aggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaa

SEQ ID NO: 7399 - DNA, 479 bp, Homo sapiens
  ENST00000550368
atggcagaattccagcagcatggaggacgctgatgcaaatgtgtatgaggtagaagagccgtatgaagctccagatggccagctgcagcttggacccagacatcagcattccagggtctcgctctgtcaacccaggttggagtgcagtggcaagatcacagctcactgcagcctcaacctcccagacttagagatggggcttcaccatgttgccaaggctggtctcgaactctgggctcaagcgatcctccctcatcggcttcccaaagtgctgggattacagacgtgagccactgcacccagctagattgactcttgatagcagtgattctaagcagctttaattcttattgagccctcacagtgttaagaagcaaaaacattttttgtgtgctcttttgtactctacaaattaatgtcttctctgcctggtctttgaaatcttggccccagtaaatatctgtgctggctatgcagct

SEQ ID NO: 7400 - DNA, 19519 bp, Homo sapiens
  ENST00000315930
gtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaagaataatcttccaacatgtatttattgagcgtccattatgtgccagtaactgaagtagcaactggaagtaaacattgtataatgcagataaggtcactgtcctcagatagtctacagtctagagagtcatattaacatgaacactttaaagtgtgtttattttactagttactgtacttgcacttcagattggtacaaaggaattcacattcccgttcagtagtcaaattatacaaatgaggcgtttgtgctagtattttctctgccactcacagtgtcatttcccctctctgttgcttatttctctcctctctagagggaatacacaggactaaatagtgtcctttctacctttgagaactgaaggaaaatgtaaatttttttaaatgttgatgacttttctctagctccccaaagctgcattgtctggcaatgaacactttgagaacagtcaatacagatggtctctgacttacagtagttcaacttacattttttcgggggctttacagtggtacagaagcaataggcatttagtagaactcatactttaccatacaaccattttgctttttatttccagtacactattcaataaatgacatgagctattcaacactttttaattacaaaatttgctttgtagtacatgattttgtccaactgtaagctaatataagcgttctaagcacatttaaagtaggctaggctaagctatgatgtttgctaggttaggtgtattaaatgcattttcaacttaagatgggtttattggtatgtgacccccatcgtaagtgaaggatcatctgtatatggagggaagaattgtgaaatacataaaacgtagttgactagtgcttttcagagcatctgcaaataaaattactggggccccaaacagcctgcttttgcaaggaggggagactcctcatttctaagatgtttggaccagattcagcatgagctcctatccctgcccaccccagcccagtctaagtcaccttgtaatttcatgagataagtcctcctcatcctgcttcatcctgcctgagctctaaacacacctacatgaggtacgctcacctgcctagctatcttggatgcaggatcctttgtaccatgttttaaaaatcaggagatgctcactcaaccacctctccctattaactcttactaattttcaatcagtagggaaaagtagtgcattgtctccctctttctctaagaactttaaagtttggtcactgactacttcagttgctggtcttgctttttctgttgttcagaaatagtgtaggtctgctggtagtaagcaaattagcactatgtgggtctcagggatgcctgcgttaataggatggagtcaaaatgcccaggaagaatcctttacccccagcattctttttgagctgccttaaagttgctttaaacagacagtggtgttaaaataaattaataagtaaataaatagtcctcaaaccttcctacaagtgatgatatcaatactttcacacatcttcattacacacacacatacacacacaccctttcccaccccatcccctcatgcacatcctttagtagcattcctcctggcagaaaatactagtcctgccacataactgatgaaagaaaaaaagactctagtcaaatagttgtgggaaacacttcaaatactattgggtctcagatattagctcacatcagaatcacctggaaggcttgtaagactcagatcactggacttcaccttcagagtttctgattgagtgagtcttgtgtgggcccaaaacttggcatttctaacaagtttccaggtgatgctgaggctgttgatcctcgggactttgagaaccactggtattagttcattctcacgctgctataaagatactacctgagactgggtaatttataaaggaaagaggtttaattgactcacagttctgcatggctggggaggcctcaggaaacttaccatcatggcagaagatgaaggggaagcaaggaccttttccacgtggcagcaggagagagaatgggaaagcgccacttatcaaacagatttagtgagaacttcctcactatatgagacagcatggggaaaccgccccgaggatccaatcacctcccaccaggtccctccctcaacacattgggattacaactctaaatgagatttaggtggggacacagagccaaaccatatcacactggcatacactattcctttcttcaggattagcgtgcattagcaaattaatttctgaaaagtcttgtgttaaagaaatctgtttaacttttacaaatgctgagacaaacttattgggccacaaagccacattttcatggagcgtctattaacattgcagtagagtggtagtcctcaagctttttatgtgtacctgaatcacctgtggtgttttatatgcttcttttgttttaagcttggcctgggaatctcctgaatctgatacctactgttctatgccacagcacttaatgtcagtgttctatggcatggcacttaatgtcagttttccaccccatctgtgaacgtgtattcaatcattatactgtatttagcctgagaatgaatatggaaaagaaaacaacactttcttcaggctttttgcaactttttaaaagcaaaacaggctccaattccccctcccaggagttttgtttgtatccaaagagaggacatgctcattgccatggaatccttaaaggactgagagggaagtgatctgtggcactcctcccctccctaaccagtacatttgttccagttttaagccagtcaagctcaccgaagagtttttcaaagaccttagctacatggatttaactttaccaagcatccattgtccaaatgaacatatgagggaaaatgaatatctcttcatctacatcagctgaccataactatgctgtggataaggggtggtgggatcagaactgataaccattttcaacaaatttcatacgaatgtgtcttagaagcctcatttagatgcgatgtcattcatgggtaaaattgaaatgtgccttcactggcagagtctttaacaatctctgcaagacaatctacgcttttttctattgtttctgaaaatcctttcaacctctattcaaagccattttctcactttagaaattgattacagcagggctgtgattgtcagtacaaaaatctgtacagggatatggcagtggtataatagatgaccatttccaattataaaacaattagcaaagtatagctaggtcaggccactagtacccttcaaattcttaaccatatttacaaagacagcttttcataacttttattgctctgtccacaaagatgtggtctcatggtttcacacgattgagaatgctacaagtaatagtatactgaaaagaacatgtctctaattctggactgctctttatctccaagaaacagagagagagagaatgaaaaaaaatcccagcttagaggaattttggaagttactctttcatgaaccatcacattttctgggcctttgtaatctttaaacactgttactctttagaggttggtttgaatttgttgcacagagaacaataatctatgacaaattaatgaacccttttgctaatatcacatgagtacaagtatcttgtatttctcatcacatttaccgtaataaagaatgcagacaagtataatacatggcatcattttggggattttccaatttctatgtgggcatactggaagaagtttgtaacagttgcaattctgtcacaatgcaggaagtctttctagaacacacaatgtggatgattttcagttttagaattgtaaactaaccaaatgtcaattcagtttctcattttatattagtttttgttacaaacactgcctatttctcttttgtacaaacacttcacacacacacacacacacacgcgcacacacacacacacacacacacacacacaggcacacacacactagatgggcctccaaaagaactcagagctgctgtcttcctctgggaggttgatcatatgtctattcagttgggagaatggagcagtcaagttcaaaatccatgtggctctctggcttcagaagctatcctttcagctatgacacacacactaaatagtattgcccaggtttgccctacaacatgttagcatatctacatattttgtactgtaataatgtgtacgctcttaataatttgtttttaatgctgtgtaaagttagcaattagagtaagagaaacgtatgggataatgattgagtaaaatctcagctccttttgagtcaatcactcagcttgttggcacagtagatatttatgaccttaaatactgtcagcgcttcacagcacattactgaggcctggataaagcattcacacaaagataaatggattgaaactgtgtcaattttgtagaaaaagatattctggggtttagtaacagagaatttttctttccttactgcgattaataaagtggaactccaattgcaagtaactattcagttttatgttcttcacatatggaaacctctctgtcactaataccctgggacaaactggatgattaccatccaagtgttattttcttcctcgaaaatttcaaaaccagaatgaattagttctccaagtctggctatactatagttttcttcttaatgtaaaacagctgaataaaacagcttgaacaatatttgactttcatgggtcttaagaacgtttcaaaatacaccaccaatatatttaccaacatatttagtgccagatatacacagaacaaacactaccctattgtttctgtgtgcgtgtgtgtgtgtctgtgtctgtgtgtgtgtgtagcaggacactaaataaacaagtcatgttgctgttcttagggaagttttggtaaagagagcttcaaagttccttggagtcacctgcaaggctaactgtactaaaagcggaatttgcatgatctttctacaaactctcagtgtaaagtggtagatagacatgcaagcatcacacttagattgcaataaatgctgtgatgtaaaaaatacaatggaggaaaaatttttgattagggaaatttaaacattttcaaagaagagttaatgtttcagtggagtcttaaaagatgagtaggaattcaacagccagaagggaagtgtagacgctctgtgtcacataaaacaaaacagaacagaatagtataagtgaaggcatagagcttcacatgaaaggcacatgaaatagcactgggtatctctaaaatattaattagcctagtgtagctggacaatgaggggcagagcccctggtatgcaagtgatgtctgggaaaggagcaatctttctacagtgcctcattccatcatacctcattaccagaaaaacattatgagccacttaggcctgtattatttgagcatctctgaaatggagttgctctacatgttttgtagaaacctaatgagtaatttattctcatcagtagacaaaatgaaagaaagaaaatagactctgagcaaagtatgattcacaaccttgcctattaggctatagaagattgccctactaattcctccttttcgtctgttgaacaatctgtattttgcctgctcaaaaaggaattcctcaagttataggggcagtttgaccagtacaatcatatcagaaaaaaatcagcaaaattatgttctaacaacatcttcccatctaaagtgcacattttatttttttaaggtaacataattactacgaacaaccgaaatggtatataaaggtgaaaaattaaaataattttttttacagctccacgttacctcaccccctagaccctggtaaccaccattcaactctctgtttccattagttcaactttttaagattctttttatacaaaggatgtcatgtagcatttttttcttttttcatctggcttatttcacttagtttgcttatttcaacgtgctctgaagtttcatccatgtttatgtaaatggaaggagctccctctttatatggctaagatatatatatatattatattatatatatatatgtatatatatatattatatatatatatgtatatatatataattttctttcttcattcatctgtccgtgggcacttaggttgttccataacttatctattgtgaataatggtgcaatgggaatgaatgggagtgcagatgtctgtttggcatactgatttaatttcctttggatatataaccagaagtgggaatgctggatcatacagtagttctatttttacttttatgaggatctccatactgttttacataatggcttactaatttacattcccataaacagtgtacaagaatacctccttgccaacacattatcttttaagttttggataatattattcctattaataacatgtgtgatattacattgtggttttgatttgcatttcccttatgattaatgatgttaagtaccttttcagatatatgttggccatttgtatgtcttccttggagagatgtctattcagctccttggtccatttttcaaaatacagtttacttgtatttttgctattgacttgtatgagttccttatatattttggatattaaccccttatgagaaatatggtttgcaaatattttctcctattctgcaggttgccttttcgttttgtcgattatttcctttgctgggcagataatttttttattttattttttgaaacagtgtctcactctgtcacccaggctggagtgcagtggtgtgatcatgtctcaccacagccttgacctccccaggatcaggtgatcctcccacctcagtttttgtatttttagtagagatggagtttcaccctgttgcccaggctggtctaaaactcctgggctcaagccatcttgcccaccttgggacctcccaaagtgttaggattagaggcatgggccaccatgcctggctttgaaactttttaatttaatgtagtctgacttgtttatttttactttgttgcatgtgcttttggtgttacagccaaaaaagttattgccaagaccaatgccatagacattatttcttattctagtaattttacaattttaggtcttatgtttaagtttttaatcgattttgagttgatttttgtgtatggtataggataaaggtccaatttcattattttgtatttggatattcaatgtttaaaatacgatttattgaatggactatatttccccatgatgtgtttttagtgcctttgttgaagatttgttgatcatatatgtgtggatttgtttcttggctttctattctgttccattggtctatgtgtctgcttctatgccaataccatactgttttgattactatagctttacaatataatttgaaatcaggaaatgttctaaacttctttctcaagattgttttagatctttggggacttaggtggttccataaggttttaagaattttttttctatttctgtaaaaaattatattaagattttgatagtgcttgcattgactctgtagatcactttggttagtatcaacatttttgcaaaattaattcttccaaactatgaacacaggatactgttgcacttatttctcttcttcaattcctttcatcagtatcttatagtttttaatgtacagatttttcacctccttggttaaacttattcctaagtacattttcctttttgatgcaattgcaaatgggattgtttttctaatttattttattttgtttgtttgtttgtttgtttgtttttgagatggagtcttgctctgtcacccaggctggagtgcagtggtgtgatcttggctcaccacaacctctgcctcccgagttaaagggattctcttgcctcagcctcccgagtagctgggattataggcgcctaccaccatgcctggctaatttttgtatttttagtagatagagatggggtttcaccatgttggccaggctagtctcaaactcctgacctcaggtgatccaccttcctcggcctcccaaagcgctgggattacaggcgtgagccactgcacccagccactaatttattttttggatagttcattgttagtgtacagaaacaactgattttttatgttgattttgtatcaacattggtgaattccacccaacatttgaggaaaaactaataccaatccttctcaaaatcttccaaaaaaatgaagaggaaggagcacttccaaactcattttatgaagccagcattattctcataccattccagacaaggacactacaagaaaaaaaattacaggcccaaatccctgttgaacatagatgcaaaaatccacaacaaaatactagctaaaagaacttaacatcacatttaaaggatcattcaccataatcaagtgggatttcaccaatttcacttgggtagaattcaccaatgttgataaaaaaatcaacataaaaatcagttgtttcttcacacgaacaatgaactatccaaaaaataaagaacacaatcccatttgcaattgcaaaaaaatacttagaaataaatttagcaaaggaggtgaaagatctttatattaaaaactataaaatattgatgaaagtaattgaagaagacaaatggaacagatccctttgttcatagattggaagaattaatattacagaaatgttaatactaactaaagtgatctacagagtcaatgcaagccctatcaaaatcttaatcgaatcttttacagaaataaaaaaaaattctaaaattcatatggcaccacataagtccccaaaaatctttacaacttcactgaatttatttatcacttctaacatttttctgttggagtcattgggtttctgtattgaagagcatgtgatttgaaacagaccattttacttcttccgtcctgatttgcatgcattttatttctttttctcgacttattgctctaagcagaacttcaagtaccatgtggaatagaagtggcaagagtgagcattctcttcttcatcctgatttcagaagaaaagctttcagcatttcactactgactatcacgttagatgtgagtttgtcatatatatggcctttgttatatttagggatattccttctctacctaatgttttgaatgttttcatcatgaaagggtgttgattttttttcaaatgccttttctgtatctgttaaaatgatcatatgattattatccttcattgtcttattgttcatatttattgatttgagtatgttgagccatccttttatcccagggataactctcacttgattatggtgaatgatctttttaatgtgatgttaagttcttttagctagtattttgttgtggatttttgcatctatgttcaacagggatttgggactgtattccttttttttcttgtagtgtccttgcctggctttggtaggagaataatgctggtttcatagaaaaatgagtttagaagtgttcctcactcttcttttttttttggaagatttgagaaggattgatattagattttctttaaatgttgggtagaattcaccactgaagccatctggttctgggctttactttgttgggaagttcttttttaaaaaattgctgattcaatattctttttcattattgctctctacagattctctattcatgattcagtcttgctaggttgtggtatgtttctagaaatttatctgtttcttctagattacccaacttgtgtataattgttcataatagtctctaatgatcatttatatttctatggtatcagttgtaatgtcttctctttcatttctgattttatttgtttatgtcttttctctttcactctcagttactctagctaaaggcttgtctgttttttaatcttttcaaaaaacaactcagttttattgctcttttttatttttctagtttctatttcacttttttctgttctgatatttacttcattccttcttccgactttgggattagtttatggttcttttatagttccttgaggtgtaaagttaggtcgtttatttgattttttttttcttaatgtaggcatttatcactataaacttccttcttagaaatgccttttgctgcatcccatatattttggtatgttgtttttccacttttgtttgtctcaagttttttaaatttttcttttgatttgctctttgattctttggctatttaggagtgtattgtttaattttacagttttcctccctttactgatttccagtttcttagcattgtggtcagaaaagatatttggtatgatttcaatcttcttagttttgttaacacttgttttgtggcctaacagttgatgtatcttcaaaatgtacctgcgcaattacttgggacgaatgtacattctattgcttttggagggaatgttttgtatctgttaggtccatttggtctaaagtgtagttcaagtcaattccctattgattttctgtctgggtgatctgtccattgttgaaagctgggtatcaaagtcttctactactatactattacagtctatatttcctgttcatatctattaatacctgctttatatatttaggtgatccaatgttgggtgtgtatatattcaaaattgcatcttgttgatgaattgactcatttatttttatataatggcattctttgtctcttgttacagtttgtgactttaagtctgttttgtctgatatagtataggtgtctctgcttctttctggtttctatttacatgcaatatctttttaatctcttcactttcagtttatacgtgtccttgcagctaaagtgactatcttatagatagcaagtacttagttcttcctttttcatccattcagccactcactgtcttttgattagagaatttaatctacttacattaaaattaattatttataggtaaagacatactattgctactttgttaaatgtttttcagctgttttgtaagtttttttgtttctttcttcctctcttgctgtctttctttgtgattgatgattttcctgtagtactatggtttgatttctttttttttaataatttttatttttattttaagttccagggtacatgtgcaggatatgcaggtttgttacataggtaaacatgtgccatggtggtttgctgcaccttcaacccatcactgaggtgttcagccaagcatgcattagctatttttcctaatagtatctctccccacaccccaccccccttgacaggccccagtgtgtattgttcccctccctgtgtccatgtgttctcatgttcagctctcacttataagtgagaatacgcagtgtttggttttctgttcctgcaatagcttgctaagaataatggcttccagcgccatgtgtgtccctgaaaatgacatgatctcattcctttttatggctgcatagtatcccatggtgtatatgtgccacattttctttatccactgtatcattgatgggcatttgggttgattccacatctttgctcttttgaacagtgctgcagtgaacatatgcgtgcatgtatctttgtaatagaatgatttatattcctttgggtatatacctagtaatgggattgctgggtcaaatgttatttctggttctagatctcggagaaatcaccacactgtcttccacaatgtttgaactaatttactttcccaccagcagtgtaaaagtgttcctatttctctgcaaccttgccagcatctgtcattttttgactttttaataatcaccattgtgactggcatgagatggtatctccttgtggttctgatttgcatttctttaatgatcagtgatgttgaacttttttcatatgttcgttggcctcatgaatgtctttttttgagaagtgtctgttcatgtcctttgcccactttttgatgcggttttttttttcttgtatatttgcttaaattccttgtagattctggatattagaccgttgtcagatggatagattgcaaaaattttctcccactctgtaggttgcatgttcactgtgatagtttctgtctttctttctttttatattatacttgaagttctggggtacatgtgcagaatgtgcaggtttgttacataggtatgcacgtgccatggtggtttgctgcacccatcaacccgtcatctatattaagtgtttctcctaatgctttgacttcattatttctttcatttgattgagtatgctgtggatgttttctgttacttttttaattttattcattgtattcttcagcttcagaatttgtttgtttgtttgtttgtttgtttttcacagtttctatctctttgttgaacttattattttggtcatacattgttttcctgattctactgacttctttgtctgtgttctcatgtagcaacccaagcttatttaaaacaattatttttaatattttgtcaggaaatttgtagatctccatttttttttgttggcaactggaaaattactgagtttcttcggtggtattatttttgtgttgtttttggcaggtgttccttgaaatctcgtgttgccatgttcacatttgaagaagtagtctcctccttcagcctatactgactggcttcagaagagaaacagttataccagttagcctgactggggatactaagactcttgcacatcttttctgtagatgtgtcactcaagctctttttgagaaattttaagatcatctgtattttcttaatttcataaaaccaaaccaaattctgagagtttcccatttgttttctctaacgtggtgccctgaagtgctcaagtttttgtgccttctcccattcccacagagtcaagctgcctgcttctgcatgcacacaagttcacactcgctgtcagggtttgggccgtgtgcagggagcaagccaaggtagaggagagagggagacatgcaaagttttgggagcacccatgtgtcagcttcgggggtttacagttcaggcatcccaagccactagtgggtgggcctcctgatggagtctgtgaagttgttagtagtatatgtgtccttttgttgaatttccagtctctggttgctgtgagcccctaccgctgttccctgctcacagcctctcagtcactcagacatgatgatcccctcagtattctgagtggggatagaaagaagtaggcctcttggtcagtgtcccacgtggctaggaaagccaggcattcatttactacactctccctttcacccaatggagaaatcatgagtcaaagttgtatctcttggtgttgagttctgctagcttgagagacggttgacataagtagtgaaactattttctggttcttttcaatgtgcctattctcgtaattgttttgctccatctgtgagctggactaccagactcccacaaaggtactctcatacttgagtggttgtcaaaattgtagatagtggggaaatgacaggagaaaattcctgttctgccatcttgctgacatcaccccaatatctaaaatgcatattttaattatttttttccttgaataaagtttattttggaattgttgagttttacaaaataatttaaaatattctctctctctctctctctctctggggttgaggtctcactctgtcacccaggatggattacagtggcacaatcgcagctcactgcagcctcgaatttcttgggtcaagtgatcctcccacttcagcctcccaagtagctgggactacaaggcgtgtgccaccatgcccagctaatatttttacattttttgtagagatggggtctcactatgttgcccaggtgggtcttgaactcctggcatcatgtggtcctcccacctccacctcccaagtcctgaggataccaattgtgagtcactgtgcccagctatccccttctcactctctttttctctcacacacatgtgtgcatgcacagacacacacacctcatgttcattctctttaccatgatgatccttggttcttttacacagcttctttcagtttaccttacaatttagctcaacacaaattttaaaaaacttatagttacaatttaatttggcttggtccacacctctaacaaatttgatacaatctccaacttacggttgcaagttagttgattatattcacttccaagtatttcccccaacatttcattatgaaaatatatccatcaattaatgctcttatctataaaataattatttttttgcatttcaaaataagttacagacatcaatgcacttcatctttaaaccctttatcatgcatatcaggaagtagagtttaatatttctatatttcttgggggagaaatggagctaaaattatatactgtatcatatacaaacctgttaggtatatcaattcatgtgtattgacaaatgcgtgcaccatgtaacagaaactcctttcaagatatagaatattcctatcactacaaatattaatcaccaaaacaatggggagaatgtctctagggcatgtcagagaccttcactgcagcctctcccattataggccaggaggccttgaaggaaaaaaatggtttagtgggccaggcctcaggcacccccccttgctctttgcagccttgaaacatggtaccctgcgtccccagctgcttcagcttcagctgtggctaaaaggggccaacatacagctcaggccattgtttcagagagtgcaatccccaagctttggcagcttacacatggtgttgggcttgcaggagcacagaagtcaagaattgaggtttgggaacctctgcctagatttcagaggatgtatggaaatgcctggatgtccagacagaagtctgctgcaggggtagagctctcagggagaacctctgctagggcagtgcagaagggaaatgtggggttggagctcccccacagagtcttcactggggcactgtatagtggagctctgagaagagggccatagtcctccagaccccagaatggtagatccaccaatagcttgcaccatgcacctggaaaagccactggcactcaacaccagcccatgaaaagagctgtgagggtggctgcatcctgcaaagccacaggggaagagctgcccaaggctgtgggagcccaccccttgcatcattgtgacctggatagatgtgagacatggagcctaaggagatcattttggaactttaagctttaacgactgccctattggattttggacttgcatgggcctatagcccctttgttttggccaacttctcccatttggaatgggtatttttactcaattcctgtacccccattgtatcttggaaataactaacttgctttagattttacaggcttataggtggaagggacttgctttgtctcagatgagactttggacttggacttctgggttaatgtttgaatgagttaatactttgggggactattggaagggcatgattgtgttttgaaatgtgagaacatgagatttgggaggaactagggtcagaatgatatggtttggttttgtgttcccacccaaatctctccttgaattgtaataatccccatgtgtcaggggtgggaccaggtggaggactgaatcatgggggtggtttccctcatgctattctcatgatagtgatttataacagatccaatggttttataagcatctggcatttcccctgctggcactcattctctctcctgccaccctgtgaagaggggccttccaccatgattgtaagtctcctgaggcctccgaagccatgcggaactgtgagtcagttaaaactctttcctttataaattacctagtcttgggtatttctttatggaagcatgagaatgaactaatgcacagggtaaaaatttaaaaacaaacatacaaatgcaagtaaacaagccaatatttcaactgttcccattgcattatccttattctttatctatggtaccagaaaataatacatctgaaacaatttttttttcctgccatgatgtacactcaagtgggtccactggggtttctttcagtttcccaaatactagatatgactcttccctataccttatcttcatatgaagaaagctatgagaatatattaataactgaatatagtaacactactataggaataagcatgtgtatattccaactgatcttttaaaacttttattttgaaatatttatagattcaaaggaagatgcaaagagtatagggaagtgctatatgccctttatctagttcctctagtggtatcaacttacataactgcagtatcatatataaaccaagaaattggcatctgtataatccacagacattactcagacttctctagttttacatacactaatttgtatgtgtgtgtgtgtgtgcgtgcacgtttatgtgtgtaggtctatgcaattttaccacatgtgtatatttgggtaaccactacaatgatcaagatatggaactgttccgtcaccactaagatcccttgtgctattcctttataaacatctccctgtcatcctttttcacccataaaagctagtaaacactaatctgttcttcatccttataattttattatttcagaattgttatataaatgtcatcatacagtatataacacatagagattggcttttgtcactcagcacaattcccttgagatgcatccaaactgttgtgtatatcagtaatgcaatatgtttaatttctgtgtagtattccatggtagagatgtgccatagtttaactattcacctgttgaacaacatttgtgttctttctacttttgggctattacaaataaagttgctatgaacattcatgt

SEQ ID NO: 7401 - DNA, 1939 bp, Homo sapiens
  ENST00000305414
aaactttctctgatctcctctctctctgtgtctgctccaaatgtagacagcaattgtctgggtaggaccagcttataaagaagcatggctttgttaaggaagtcgtattcagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 7402 - DNA, 1625 bp, Homo sapiens
  ENST00000441825
gtaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaacc

SEQ ID NO: 7403 - DNA, 1039 bp, Homo sapiens
  ENST00000626909
gtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaag

SEQ ID NO: 7404 - DNA, 1165 bp, Homo sapiens
  ENST00000436198
gagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccatta

SEQ ID NO: 7405 - DNA, 687 bp, Homo sapiens
  ENST00000455663
gtgacttgctcctgcttgccttcctccatgattgtgaggcctccccagccacgtggaactaggtgtcatgaggacaagcatgaaaaaagtagggatgcatcatttgagttcttcaggaggaagctactacctaattctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgc

SEQ ID NO: 7406 - DNA, 652 bp, Homo sapiens
  ENST00000448673
gtgctttggctcagatgcagactattgcaaaccgcagaaactcacagtgacgacatgaccaagaagcttcctacccctggcctgggagcaagtgaccgtgggcgctaataacaacagggccctttaagattttggtccatggtgggatcttgcttgtttctcaccaccaggcccattgcgtctccacttctaaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaacc

SEQ ID NO: 7407 - DNA, 352 bp, Homo sapiens
  ENST00000421460
acctccttccccccccccgccacccgacacctcctaatcctaaactccttatccaccccaaccctccgggaaggcaggagtttgcacccttcgacacgccgcgtgcaaagcagggggatctatcctccctggccacatgggcctttggctgatggaaaggctgggctttgaggaagctgcatagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaag

SEQ ID NO: 7408 - DNA, 892 bp, Homo sapiens
  ENST00000334134
gagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcc

SEQ ID NO: 7409 - DNA, 4555 bp, Homo sapiens
  ENST00000312465
gcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagaca

SEQ ID NO: 7410 - DNA, 5234 bp, Homo sapiens
  ENST00000456523
tatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtcttta

SEQ ID NO: 7411 - DNA, 390 bp, Homo sapiens
  ENST00000380628
atgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagctccagaggagcgtggacaccaccggcggtctga

SEQ ID NO: 7412 - DNA, 658 bp, Homo sapiens
  ENST00000507780
aaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtaacacactagaaacttaagtacaagcaaacttcagacccctttaaagggacgcttcggccgaggataccgcaatggatcaggaagaggggctgaaggccttggacaatattgtcactcaattcaacgcctatgaagatttcctggactcgcagatcactactgtggacttgtactacctggagccaatcccctccccagctacccccgctgcagggtggtgggggacagagtggagttcttgtcctgtgccacgggagaacccggacgcgcaggaattaacaagtcatcagtgctaggaagctgggaggcggacga

SEQ ID NO: 7413 - DNA, 3042 bp, Homo sapiens
  ENST00000503413
ctcagtagggccagatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccaccggcggtctgaagatttggcagccagcagtctccagaggggggtcggaggcgcgcaagtgggtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaatt

SEQ ID NO: 7414 - DNA, 2545 bp, Homo sapiens
  ENST00000311575
cacagggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgagggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtcttagaccggggggtactgtgatagagattggggagaagtccaggttctcgaatgggggtgggggcaagggtaagggtgagatgcttgggatgagagtgtaaggggtatggagaatctctgggatagcagagaagttaaaaattttgaaaagtctcagtcctgattaagagcaggaaaaataatggaaacagaaataggcgtactttaaatgtgcaaaaactggagactggggagagaaatcgatgcagagggaggctgagaataagggggagatagagtgactaaagtgatgtgagtcccatgtggggagggggatgcaatgtttattgtttaacatttctattaaatgcagccatgagcaattgccaacctgagccaggttgaatcaatgtcttctcacttaatcagctaacaagactgcagactttttttccgtttctgaattggtataaacttggatgcggcgtggtgggtgtcatagataacctctatagggacagaagcctcacaggtcaaaactggctccaaggaaagttttgcagaatgatttcctttccattcttttagaagagctacctttttttttttttttccctgacagggtctggcttgcccaggctggagtgcggtggctagtcacaggtgtaataataggcactgcagtctccaactcctggcctcaagggatcctcacatcttagcctccagaatagctaggagtaggagtagctgggactacaagcatgcacagctgcacttggcttagaagtgctactttatttttatttttgagacagggtcttgtgtcatccagactggagcagtggtgcaattatggctcactgcggcctcgacattccagtctcaagtgatcctctgcctcagcctccggagtagccaggactacaggggtgtgccactagaagtgctactttttaacgaaatggtgactaatgttctggaactttcccattaaccttctgcatttagaaggaattatagatgttgagtgctccagtaaacagtgattctctttatatctgatttttttttttaaacagctaaaatgtaagtatgtatctcagagtcattttgaccattatggaagttgtatctctctgtttcatgtaactaattattaatatatttcatttttagtgtgatgtaatgagagactgtgtgtgtatgttaggtgctcaataaaaactgtatggttagatttaaagaagtggcaaggcaatggaaattctacctgcatttgatctacttccaagtacaccttgaattaagttcttaaacacatcttgaattgctgggaaaagacagaaactaagaagttgacataaagcaagagtcacaaactggcagccacctggccttatcattgttctatttgatttgcaccctggttctctttctttttcccttcctccccaccttcctcccatccattgttgaatctgtggatgcagagcccacggatgtggaggggcaactatatatatgtttttccattatatatataaatgtgtgtgtgtgt

SEQ ID NO: 7415 - DNA, 5702 bp, Homo sapiens
  ENST00000397091
gccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 7416 - DNA, 5590 bp, Homo sapiens
  ENST00000532791
agcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataatta

SEQ ID NO: 7417 - DNA, 570 bp, Homo sapiens
  ENST00000526688
ccaccttcaagcagctggtggaagacctggaccgcatcgtggccttgacctccaaccaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagag

SEQ ID NO: 7418 - DNA, 3680 bp, Homo sapiens
  ENST00000397113
gctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatt

SEQ ID NO: 7419 - DNA, 3824 bp, Homo sapiens
  ENST00000356207
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 7420 - DNA, 4157 bp, Homo sapiens
  ENST00000335922
gcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggatggcagctgtgacccgggatttcggtgagatgcttctgcactctggccgggtcctgccagccgaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttc

SEQ ID NO: 7421 - DNA, 3816 bp, Homo sapiens
  ENST00000326324
cttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgctt

SEQ ID NO: 7422 - DNA, 5528 bp, Homo sapiens
  ENST00000526570
tgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgcgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaa

SEQ ID NO: 7423 - DNA, 2953 bp, Homo sapiens
  ENST00000397103
gtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgt

SEQ ID NO: 7424 - DNA, 842 bp, Homo sapiens
  ENST00000531196
gtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagcttcctgccgcaggtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagc

SEQ ID NO: 7425 - DNA, 2870 bp, Homo sapiens
  ENST00000397108
aacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggca

SEQ ID NO: 7426 - DNA, 540 bp, Homo sapiens
  ENST00000533619
cagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaa

SEQ ID NO: 7427 - DNA, 1499 bp, Homo sapiens
  ENST00000527114
cacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaac

SEQ ID NO: 7428 - DNA, 1608 bp, Homo sapiens
  ENST00000487647
atgtggagctggaagtgcctcctcttctgggctgtgctggtcacagccacactctgcaccgctaggccgtccccgaccttgcctgaacaagcttgcccagatctccaggaggctaagtggtgctcggccagcttccactccatcactcccttgccatttggacttggtactcggcttagtgattagaggccctgaacaggtggtggtatccctgctctgctggagaggaacccagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggagg

SEQ ID NO: 7429 - DNA, 823 bp, Homo sapiens
  ENST00000466021
tcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacg

SEQ ID NO: 7430 - DNA, 790 bp, Homo sapiens
  ENST00000527745
gggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaac

SEQ ID NO: 7431 - DNA, 486 bp, Homo sapiens
  ENST00000524528
ggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgg

SEQ ID NO: 7432 - DNA, 485 bp, Homo sapiens
  ENST00000475621
cctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagagg

SEQ ID NO: 7433 - DNA, 276 bp, Homo sapiens
  ENST00000530701
tcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagactgctggagttaataccaccgacaaagagatggaggtgcttcacttaagaaatgtctcctttgaggacgcaggggagtatacgtgcttggcgggtaac

SEQ ID NO: 7434 - DNA, 545 bp, Homo sapiens
  ENST00000464163
tcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcag

SEQ ID NO: 7435 - DNA, 2281 bp, Homo sapiens
  ENST00000470826
ggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaa

SEQ ID NO: 7436 - DNA, 1898 bp, Homo sapiens
  ENST00000496296
gcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcatt

SEQ ID NO: 7437 - DNA, 556 bp, Homo sapiens
  ENST00000527203
ttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgcc

SEQ ID NO: 7438 - DNA, 571 bp, Homo sapiens
  ENST00000533668
gcgctcgggagctggcgaggcggcggcggctcctcaatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagat

SEQ ID NO: 7439 - DNA, 1155 bp, Homo sapiens
  ENST00000525001
tttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaa

SEQ ID NO: 7440 - DNA, 725 bp, Homo sapiens
  ENST00000532386
ctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccgg

SEQ ID NO: 7441 - DNA, 764 bp, Homo sapiens
  ENST00000474970
aaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgt

SEQ ID NO: 7442 - DNA, 657 bp, Homo sapiens
  ENST00000526742
ttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacg

SEQ ID NO: 7443 - DNA, 688 bp, Homo sapiens
  ENST00000529552
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcatt

SEQ ID NO: 7444 - DNA, 826 bp, Homo sapiens
  ENST00000484370
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagcttgcccagatctccaggaggctaagtggtgctcggccagcttccactccatcactcccttgccatttggacttggtactcggcttagtgattagaggccctgaacaggtggtggtatccctgctctgctggagaggaacccagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacct

SEQ ID NO: 7445 - DNA, 467 bp, Homo sapiens
  ENST00000530568
accacctccctccttaacatttctggagacttggagatgcggcgttgagattcgggggagaaaagaaagttcccttggatcccgagttatttaagatctcaccaagttattcgccgccgctgggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaa

SEQ ID NO: 7446 - DNA, 529 bp, Homo sapiens
  ENST00000434187
aaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctgtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacac

SEQ ID NO: 7447 - DNA, 777 bp, Homo sapiens
  ENST00000397090
cgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggc

SEQ ID NO: 7448 - DNA, 587 bp, Homo sapiens
  ENST00000413133
aactcgcgctcgggagctggcgaggcggcggcggctcctcaaccttgattctgcagtgggacctcccaggcccccttgccccccgcaacttctggactcatatccgtcagacatcacttgtcaccttccagcatcagggagaactggatccctcctggctccacactcttaggctctttggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctc

SEQ ID NO: 7449 - DNA, 389 bp, Homo sapiens
  ENST00000440174
caaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatgggtcagtttgaaaaggaggatcgagctcactgtggagtatccatggagatgtggagccttgtcaccaacctctaactgcagaactgggatgtg

SEQ ID NO: 7450 - DNA, 584 bp, Homo sapiens
  ENST00000496629
accacctccctccttaacatttctggagacttggagatgcggcgttgagattcgggggagaaaagaaagttcccttggatcccgagttatttaagatctcaccaagttattcgccgccgctgatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctg

SEQ ID NO: 7451 - DNA, 442 bp, Homo sapiens
  ENST00000480571
tgtgtgtttttaaggactgatttgggccgcatcccccggaaactaaagtggggtgttttaccgtttaaataacggctacagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttgggga

SEQ ID NO: 7452 - DNA, 5375 bp, Homo sapiens
  ENST00000425967
ccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctga

SEQ ID NO: 7453 - DNA, 5900 bp, Homo sapiens
  ENST00000447712
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 7454 - DNA, 5482 bp, Homo sapiens
  ENST00000619564
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 7455 - DNA, 6054 bp, Homo sapiens
  ENST00000341462
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagttcccatagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctg

SEQ ID NO: 7456 - DNA, 4255 bp, Homo sapiens
  ENST00000358487
cccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactta

SEQ ID NO: 7457 - DNA, 3990 bp, Homo sapiens
  ENST00000478859
acagactctcccgcagaactgaccccagcaagaagcctttgggagcagtagagatggagtttcactatgttgcccaggctagccttgaactcctgacctcagatgatctgcccgcgcaggcctcccgaagtgctgggattacaggcatgagccaccgcacctggcctgccaactcttgttaagatctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacctcgctgattgagaagacttcactctctctgcaaagagacgtgtgtgttttagaggaagtgggagccccagccgattctgcaagacttccgagagtcagatatccagacagaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacagctctttggcgttgctaagagactgccattttggaggaaagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaaga

SEQ ID NO: 7458 - DNA, 1736 bp, Homo sapiens
  ENST00000638709
gccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacc

SEQ ID NO: 7459 - DNA, 3547 bp, Homo sapiens
  ENST00000356226
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaa

SEQ ID NO: 7460 - DNA, 3244 bp, Homo sapiens
  ENST00000369060
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaa

SEQ ID NO: 7461 - DNA, 3501 bp, Homo sapiens
  ENST00000604236
ggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatat

SEQ ID NO: 7462 - DNA, 3003 bp, Homo sapiens
  ENST00000369059
ggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacc

SEQ ID NO: 7463 - DNA, 497 bp, Homo sapiens
  ENST00000467584
ggggacccacaacatgttaccggttttcattttgctggggctcgcatttgaagcaagggctctagtgaggaggtggtgtagactcagcgggttatttaggtccgtgtgaagccgagttgcctgcccagcacctatagctcaactaggttttattgttctctacctgtcaatagttgatttatgatggattccaagagaaaagctaaggacagcctggggtacatcagacgtggtctcagggaggtcttcgtggaagtcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcc

SEQ ID NO: 7464 - DNA, 1138 bp, Homo sapiens
  ENST00000429361
ttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaat

SEQ ID NO: 7465 - DNA, 2472 bp, Homo sapiens
  ENST00000346997
ggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 7466 - DNA, 3061 bp, Homo sapiens
  ENST00000457416
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 7467 - DNA, 3001 bp, Homo sapiens
  ENST00000360144
gagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtctcaaaaaaaaaaaaaataaaaa

SEQ ID NO: 7468 - DNA, 2650 bp, Homo sapiens
  ENST00000369056
ggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtct

SEQ ID NO: 7469 - DNA, 2727 bp, Homo sapiens
  ENST00000369058
cgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgag

SEQ ID NO: 7470 - DNA, 2593 bp, Homo sapiens
  ENST00000336553
cgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattc

SEQ ID NO: 7471 - DNA, 386 bp, Homo sapiens
  ENST00000463870
cactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtgg

SEQ ID NO: 7472 - DNA, 1478 bp, Homo sapiens
  ENST00000490349
tcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggt

SEQ ID NO: 7473 - DNA, 1680 bp, Homo sapiens
  ENST00000359354
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagacc

SEQ ID NO: 7474 - DNA, 730 bp, Homo sapiens
  ENST00000491475
gattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcaca

SEQ ID NO: 7475 - DNA, 579 bp, Homo sapiens
  ENST00000613324
gtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcaca

SEQ ID NO: 7476 - DNA, 435 bp, Homo sapiens
  ENST00000611527
aggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcaca

SEQ ID NO: 7477 - DNA, 587 bp, Homo sapiens
  ENST00000636922
tcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcac

SEQ ID NO: 7478 - DNA, 574 bp, Homo sapiens
  ENST00000491111
atttctgtggaccggtctggtggtatcacctgggactctgagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagaatggcttctggtggcatgtgacttattggaaagaggctaaccctgactgctgccaaggagaccaatgggagactgggtcccagttggtggtccaggctgcgccacaccgtaggagtccataacaagaagggctggcctctgttgcccgttgatgcatgagccatctcagcagagcaggccgtccccagttattccttgtcccagatgcctctgctggtttgtcctagtgcctgctaaccctcagctgttgccacttggatattatgtcaagc

SEQ ID NO: 7479 - DNA, 3690 bp, Homo sapiens
  ENST00000357555
aatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 7480 - DNA, 4369 bp, Homo sapiens
  ENST00000613048
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 7481 - DNA, 3803 bp, Homo sapiens
  ENST00000369061
tgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 7482 - DNA, 2478 bp, Homo sapiens
  ENST00000351936
ggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggttttcgccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 7483 - DNA, 4217 bp, Homo sapiens
  ENST00000481110
gcggcgtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgct

SEQ ID NO: 7484 - DNA, 4132 bp, Homo sapiens
  ENST00000260795
tctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 7485 - DNA, 3733 bp, Homo sapiens
  ENST00000352904
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 7486 - DNA, 336 bp, Homo sapiens
  ENST00000507588
aaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaagacggcgggcgctaacaccaccgacaaggagctagaggttctctccttg

SEQ ID NO: 7487 - DNA, 545 bp, Homo sapiens
  ENST00000474521
cagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcaggtaacgactctgtcccatgccggccggcacaagagctccagctccaaggccctggccgcgcgccctgcacgccccgcacgcccagccc

SEQ ID NO: 7488 - DNA, 821 bp, Homo sapiens
  ENST00000469068
agatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaatcttcattcaatgctggtggaagtcagaacgcccccccttctggcccagcactgacccccggctgtacctccacgccctgtcgcccacgcggcgccaacctgcccctgctgacccaagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgccc

SEQ ID NO: 7489 - DNA, 4293 bp, Homo sapiens
  ENST00000340107
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 7490 - DNA, 3951 bp, Homo sapiens
  ENST00000412135
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 7491 - DNA, 4287 bp, Homo sapiens
  ENST00000440486
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 7492 - DNA, 4438 bp, Homo sapiens
  ENST00000613647
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 7493 - DNA, 563 bp, Homo sapiens
  ENST00000582567
ggccgcgctttacaggggccgcgctttacaggggccgcgctttacaggggccgcgctttacaggggccgcgctttacaggggccgcgctttacaggggccgcgctttacaggggccgcgctttacaggggccgcgccggcgggggcgggatcgcgcgcaaggcggggctgtagccgccccgggaccgccctgctcaggcgccgtggggttcggcgcggctacgtgcagaatccgtctagctaaaatgtaatttcagattggacaagtactagagggagtcaaaagtgaggaacccaagcctgagcacgtgggccagccccatggggaatctgtcttgtcatcggggctggctggagtagagacaagtctggatgctggctggccaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcct

SEQ ID NO: 7494 - DNA, 681 bp, Homo sapiens
  ENST00000413489
caaggcggggctgtagccgccccgggaccgccctgctcaggcgccgtggggttcggcgcggctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacg

SEQ ID NO: 7495 - DNA, 4072 bp, Homo sapiens
  ENST00000634606
gtagccgccccgggaccgccctgctcaggcgccgtggggttcggcgcggctacgtgcagaatccgtctagctaaaatgtaatttcagattggacaagtactaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggaacctgtcttaaatcctccaaggtgtcattcatttagttatttgacactaagcccctaagtgaaattataactatggctaaaatccttcctcattttggaggcttctaatccaagaaccaaagatgccaacattcttcctctgtgactattttaactttgtggttatgatacctattgccacactttcagtcctacttgtccacacttaaacaccatgctttcccattctgagtgatggcaccctcatccccacccaaagctactgtgggtgctactgccttacagagtatactgtggtgtgctgcctggatatttccagcatcttggagtgctttcagcagacagccatcagccatcagccttctttgtgaattgcctaggctgccacgtcacctctctagggcagcccacatgcaatgaatgatttgtcaacatggaagcgtacagaccaactcccctcattcaaacttggaacaacttggaaggaccattccagcttcagcactccccagggataagtcaagactttcattgagcctgcaccacaacctgctttctccctctgcccactacttcttccttccctcctctctcacagctgttattcccaacagcatttcttaataaccctccaacatgctaatctccatctcagggtctacttcctggaaaatccaatttacaacaggctgcaataacaaaagtcctcgaagttaagattttttttttctgtttatggtacaattttaaaatctcttgctctatggatgcgcattctctagtgacagagatgtcgtctcccttaatttgaacttgcacttggcttcaatttctccattgaatccttagagtaatctctctttgggcagcccaacaggttggcaataacatctcttggaagtaaaatgcattaaaaggcagtttcattaagtgatataaaatccatgtaactcaagtcttcaacagccctagaagtaaaatttccagtatctcatacagttcctaaattaatattaatttcatagcaagagtgagtttcaagccagtgtgaaaaataaatgaatattcatttttacacacagtgggaaggaatccacatccttgatcacctttctccagtctctaccttaatagttatgctggctgaaaatatccataggatatttgtccctatcttcccagtcccattacctaaacattcagatccaagtcaattatggtcaaggttgttccattaacagaaagctaaatcttacccataatgtctgggattggtcttgcttccctaaaccctagtatggtatttgatggagctcaaatacaccttaggtatttgtgcccactgtgtttacaggtctaagaacaaggaggtgttgtaaaacgtcagttttcattcctgtctctctttctgtgactctgcctcgggcatataaatctcctccctcggggcctggaaactattattccaaagtacctcccagattctgaaaattgtcacagctgctgcattcagcttcttctgaactttgatattgacttgaggtagcctgagtttgcaatttgctataattctttgcctatttgattgcagaccactcttgtgggcatcatccagaaaagcaaactaatccctatggtggatctcatatcattctggctacctctgtctcggttgctgagattgagcctatgttgcagttctttcctttctccctctttcttccctcccttcttttatgccttcatccttccttcctaccttcaacatttgcaggacatgtgtttgggggtctgtggaaggggaagctttacctaaacaatgctgtcagaattctctgtgtgtgggttcaataatttccttcaggaatgaatgctttgctgctgacgtccaattgcactctttgctgctgacatgatctctctactagcatgactgcaggaactgtatgtctagatctgcatctgtccaggtcagagtcttctagctgatatccattctgagacattcagggttacctagaaatcagcaggaaagccttagaattctcagtttcttcatttcatcatttgtatgtgtaagacacagatatcttctttacaagtagggcctactgcagttctatttaaagtgcctagctagggattttctcctcttatcatttatctatttacttacagaccaactcagaacataaaatctctttctcatcctttctccccaacacacacaaaa

SEQ ID NO: 7496 - DNA, 905 bp, Homo sapiens
  ENST00000474476
ccgtggggttcggcgcggctacgtgcagaatccgtctagctaaaatgtaatttcagattggacaagtactgggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgct

SEQ ID NO: 7497 - DNA, 693 bp, Homo sapiens
  ENST00000462744
gctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgc

SEQ ID NO: 7498 - DNA, 2052 bp, Homo sapiens
  ENST00000371218
cccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaa

SEQ ID NO: 7499 - DNA, 1947 bp, Homo sapiens
  ENST00000495718
agaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctc

SEQ ID NO: 7500 - DNA, 471 bp, Homo sapiens
  ENST00000583635
aaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggagctagataagggcctggttccacttctcagtattcagggaatggattccctgcttactcccttccttcctttggatgccacaaaatgagcacttgactgaaaatatgcttatacgcgtttttacagactacgccaagccacagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctgga

SEQ ID NO: 7501 - DNA, 1976 bp, Homo sapiens
  ENST00000303721
ggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 7502 - DNA, 2485 bp, Homo sapiens
  ENST00000430447
cccttccttcccctttcccgcagtcgttgcctcctcctcccctgcctcctcctccccttcctcctcctggccgcttagtctcacacccgccgggccgttgttcccgagacgttgttgagtcccctgtgtcctcttctggactacgccaagccacaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatagatagctcagttgtggacgatagcagcaatgggaagcagtatttgagaagaaatcagactctcttcttccagtcttttgcaagacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttg

SEQ ID NO: 7503 - DNA, 5360 bp, Homo sapiens
  ENST00000634364
acacccgccgggccgttgttcccgagacgttgttgagtcccctgtgtcctcttctgggagctagataagggcctggttccacttctcagtattcagggaatggattccctgcttactcccttccttcctttggatgccacaaaatgagcacttgactgaaaatatgcttatacgcgtttttacagactacgccaagccacagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaataggagagggagtcaaaagtgaggaacccaagcctgagcacgtgggccagccccatggggaatctgtcttgtcatcggggctggctggagtagagacaagtctggatgctggctggccaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataaagtttttatcagttataattttttggcatgatcaggttatctttggtgtacacttcagggttttgtatttcaaacacaactcttcttaaaacttttcatgtgtcccagatgtgacctagtttccttctgggaaatgaatgctgagtgttgtacagacaagtcaaacagacatagctattttaggagtcattaatgtagtgcttatagaaaccaaatatgtaaacccacctggccaggaaaacctttattgagtatatactttgtgctgagtgatattccaggctccagaaatgaaaatacaaagggcaaggcccaatcttgaagagctcatgaactagtaaaagagaacaacaaacatgttacaaggcaaaaacaaattacaaatgtaaataataaagccaaagcataatatgtacaataatggaagcctgaaaaaggtaaagaagtattacataaaatggagccatttgttctgtcttaggagagctcaaaaaagccttcacagaaaaggtagaatccaagcaaattcaaaagtttaaagtccagtttggaaattttctttcaattaagtcatgacgtgtttatggacaaatatccacttgaatcaataagaaaaggaaaatgactagcataatgctgcacataaaataagaattaaaatgtttctgctctcttcgtgtatttttaaaattaaggtaaaattcagataacataaaatccacccttttagtcattttaaagtgtacaattttttagtacattttaaagtgtacaattcagtggtgtttagtacactcacaatgttttgcaaccattaccactacctaattctagaatatctttatcatccaaaaagaaaccctgtgcccattgagtagtcactggcctttccatttaccccaactcctccagcacgcgacaaccactaatttgctttctgtctctatgcctcttctggacactttatataaatacaaccatacaatatgtaggcatttgtgtctggcttctttcagttagcataatatttttgaggttcttccttgttatagcatgaatcagtactttattccttttcatagatgaataacatcccattgtatgtatatgccacatcttgttaatctgtttatcaattggaggacagtgggttgtttctacattttagctattgagaatagggctgcctccatatttgtgtacaagatttgtctgaactcttcttttcaattatcttaactatatacctaatgatatggtttgcctgtgtccccacccaaacctcatcttgaattgtagctcctataatccccatgtgttgtgggagggacctggtggcaggtaattgaatcccggtgtctggtttttcctgttctgttcttgtgacagtgaataagtctcatgaggtctgatggttttataatgggcagttctgcaaatgctgtctttcctgccaccatgtaagacgtgcctttgctcctccttcaccttccgccatgattgtgaggtcttcccagccatgggaactgtgagtccattaaacctctttttatttataaattacccagtcttgggtatttcttcatagcagcatgagaacaaatgaatacacctaggagtagcattgttgggtcttatgataacactaggtttaacttttcgaggaaccaccaaactattttttttcacgttggctgcaccattttacattcccaccagccatatatgaacgttccaatttctccacacctcaccaatattcatcacattctgttttgttttgttttgtattgttttgttttgtttactttttcccatcctagcgagtgtgaagtatctcattgtggttttcctttgtatttccctaatgactgatgatgctgactatctttttatgtgcttactggccatctgtatattttccttagagaaatgactattcagatcccttgcccatttttgaattaggttgtcttttgttatcgaattgtaagagttctgtataaattctggatataagtctcatcagatctataataggcaaatattttctcccattctgtaagttgtctatttttttgataaatcacccactccagtgacatagccaccatgtgctcacacacgcctcatcaggggcccaagcaccagcccattccagggtccactgccagtgaccctgttcattccagcagctgagtcactacacacctcacccagaggccagaggactggcccacccaaggcctgccactggtggcaacctcacccactccagtggccaagccactgaacatctgtgcaacacccaagacctaaggactggccgactcagagtctgacacctctggaaacctcacccactcagaaacagagctaccaaaggcctatagccctctcaggggccacagatctggcccactgggggcccactacactttgcaaagctgcaccatagcctccacaaactcttgcagcctaggccgctgaggcacttgcagacactgctaacattgaatacaccaaacagaatcacacagagactacactattgcacccacctggacccaaagccaaaacactacccaaccaacactaaaggacaaatctacaggaaaaattatttctttatgaaagttgctcaataaaatgagacaagacaactgctacaccagatgtgcagatatcaacataaggacacaagatgtatgcaaaagcaaggaaacctgacacctccaaaggaacataataattttcc

SEQ ID NO: 7504 - DNA, 1738 bp, Homo sapiens
  ENST00000635297
gtaaacataagaatgggccaaagacttcaacccatctgtgacttggcattgtctctgaggggggaaattttgcatgatcgcatggagaatggattttgttgctttatctgatattgtcctcagctcctcctgaatttgccgagatcttacagcagtcagtaaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaa

SEQ ID NO: 7505 - DNA, 2455 bp, Homo sapiens
  ENST00000634399
gtctctgaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaatagattcgcagaaggactgttttcagctgctggcccttccaggaatagccctaaagagccagaagggcaaaggagtaacattgaccacatcatggtgatacaaggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataa

SEQ ID NO: 7506 - DNA, 2172 bp, Homo sapiens
  ENST00000635156
gaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataa

SEQ ID NO: 7507 - DNA, 4653 bp, Homo sapiens
  ENST00000424725
gaggggggaaattttgcatgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactagatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagataaggaaaacgaagcacagagcaattaaataacttgcccaagatcgcccaagatcacccaagatgtccggctgaagttcttaaccattaccttacactaatcaacagcaacaataataataaccacctttctaggatgcaaattatgttccaagaactttcattatttcattacatctgcatagccccaagagtaaataatatcctgttctattgaagaagaaactgaggtcccaagacatgaaattacttgctcaaggtcacacactgccctcaactctgtgatgtcaaaattcccttctccataggtaacagatcctatctggctacttttcattattaaggagaatggagatgtctcggattttttgtgcacaaattgtcctcagaaccaaacaaaataaccagcataggagagaattcacaaagtaagagactcataaagtaaaatgttttgctttactttttgcctttttcatcctgctttgtttttcaacatgtgtaaatcattctgttactataaacttaataaagaagtaaaagagcaaagaccaaaaatgtaataatgaaataaagtttttatcagttataattttttggcatgatcaggttatctttggtgtacacttcagggttttgtatttcaaacacaactcttcttaaaacttttcatgtgtcccagatgtgacctagtttccttctgggaaatgaatgctgagtgttgtacagacaagtcaaacagacatagctattttaggagtcattaatgtagtgcttatagaaaccaaatatgtaaacccacctggccaggaaaacctttattgagtatatactttgtgctgagtgatattccaggctccagaaatgaaaatacaaagggcaaggcccaatcttgaagagctcatgaactagtaaaagagaacaacaaacatgttacaaggcaaaaacaaattacaaatgtaaataataaagccaaagcataatatgtacaataatggaagcctgaaaaaggtaaagaagtattacataaaatggagccatttgttctgtcttaggagagctcaaaaaagccttcacagaaaaggtagaatccaagcaaattcaaaagtttaaagtccagtttggaaattttctttcaattaagtcatgacgtgtttatggacaaatatccacttgaatcaataagaaaaggaaaatgactagcataatgctgcacataaaataagaattaaaatgtttctgctctcttcgtgtatttttaaaattaaggtaaaattcagataacataaaatccacccttttagtcattttaaagtgtacaattttttagtacattttaaagtgtacaattcagtggtgtttagtacactcacaatgttttgcaaccattaccactacctaattctagaatatctttatcatccaaaaagaaaccctgtgcccattgagtagtcactggcctttccatttaccccaactcctccagcacgcgacaaccactaatttgctttctgtctctatgcctcttctggacactttatataaatacaaccatacaatatgtaggcatttgtgtctggcttctttcagttagcataatatttttgaggttcttccttgttatagcatgaatcagtactttattccttttcatagatgaataacatcccattgtatgtatatgccacatcttgttaatctgtttatcaattggaggacagtgggttgtttctacattttagctattgagaatagggctgcctccatatttgtgtacaagatttgtctgaactcttcttttcaattatcttaactatatacctaatgatatggtttgcctgtgtccccacccaaacctcatcttgaattgtagctcctataatccccatgtgttgtgggagggacctggtggcaggtaattgaatcccggtgtctggtttttcctgttctgttcttgtgacagtgaataagtctcatgaggtctgatggttttataatgggcagttctgcaaatgctgtctttcctgccaccatgtaagacgtgcctttgctcctccttcaccttccgccatgattgtgaggtcttcccagccatgggaactgtgagtccattaaacctctttttatttataaattacccagtcttgggtatttcttcatagcagcatgagaacaaatgaatacacctaggagtagcattgttgggtcttatgataacactaggtttaacttttcgaggaaccaccaaactattttttttcacgttggctgcaccattttacattcccaccagccatatatgaacgttccaatttctccacacctcaccaatattcatcacattctgttttgttttgttttgtattgttttgttttgtttactttttcccatcctagcgagtgtgaagtatctcattgtggttttcctttgtatttccctaatgactgatgatgctgactatctttttatgtgcttactggccatctgtatattttccttagagaaatgactattcagatcccttgcccatttttgaattaggttgtcttttgttatcgaattgtaagagttctgtataaattctggatataagtctcatcagatctataataggcaaatattttctcccattctgtaagttgtctatttttttgataaatcacccactccagtgacatagccaccatgtgctcacacacgcctcatcaggggcccaagcaccagcccattccagggtccactgccagtgaccctgttcattccagcagctgagtcactacacacctcacccagaggccagaggactggcccacccaaggcctgccactggtggcaacctcacccactccagtggccaagccactgaacatctgtgcaacacccaagacctaaggactggccgactcagagtctgacacctctggaaacctcacccactcagaaacagagctaccaaaggcctatagccctctcaggggccacagatctggcccactgggggcccactacactttgcaaagctgcaccatagcctccacaaactcttgcagcctaggccgctgaggcacttgcagacactgctaacattgaatacaccaaacagaatcacacagagactacactattgcacccacctggacccaaagccaaaacactacccaaccaacactaaaggacaaatctacaggaaaaattatttctttatgaaagttgctcaataaaatgagacaagacaactgctacaccagatgtgcagatatcaacataaggacacaagatgtatgcaaaagcaaggaaacctgacacctccaaaggaacataataattttccagtagcagactccaaaaaagaaaatctatgaaatgcctaaaaatgaactcaaaataattatcttaaaaaaactcagtgagatataagagaatacaaatagaccattcaatgaattcgggaaaacaattatcatcagaataagaaattcaacagagataggtactataaaatggaaccaaac

SEQ ID NO: 7508 - DNA, 1640 bp, Homo sapiens
  ENST00000371212
atgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccag

SEQ ID NO: 7509 - DNA, 580 bp, Homo sapiens
  ENST00000475949
gtttctaaagaggtgtttggacctttaattaacattgacagcctgtctgcttaggattttgctctgctgtctccatggaaaagtcaggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttcca

SEQ ID NO: 7510 - DNA, 603 bp, Homo sapiens
  ENST00000485720
caagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccaggtcaccggattgaaactgtctcaggaccttgatgatcttgccattctctacctggccacagttcaagccattgctgtaagatactgtaatgccatttttaaagagacttagagccatcagtatactctaggccactggctccccaagatacagcacatgcttttgtgacagagattcttaattaaaagattgtttgcaaaaaaga

SEQ ID NO: 7511 - DNA, 1041 bp, Homo sapiens
  ENST00000371210
aaagcaaaatctgagcaggcttccgaggtttcctatgcaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccag

SEQ ID NO: 7512 - DNA, 669 bp, Homo sapiens
  ENST00000493891
gcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 7513 - DNA, 756 bp, Homo sapiens
  ENST00000466791
atgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagagtgatccaagaacaggacctgttactttccatccattgtcatttcatagaccccttgaagcaacccagtggttggtagcagcaatctttgtgcagatgaggactctgaagctcagaaatgttgtataacttgtttaatacaaagcccacgctctttgtattccatcagaccatatcctgtagatacatatacattgctagggaagtacactatggcaactgagacacctctcacaaggtggtatcgtttataaaaaatagcattatgtatttgtcatcattgcttggttgagtgtccaacacagaaataaaaataa

SEQ ID NO: 7514 - DNA, 623 bp, Homo sapiens
  ENST00000476939
gtcaccggattgaaactgtctcaggaccttgatgatcttgccattctctacctggccacagttcaagccattgctgaagcaatggcaaaaatgagcaaagttgggaaagttgtgttcccgagactacaggataaaaaactatttcctgtatgatatcctatgggaagccagaggtgttgtaatccagaaacacccattgttcaccaggactgcaggacacatgctttcagaattcaagggcatagttacaaataattaccatcaagaatttaaaatgaaggacatcgttgctaaacaagaaactaatgactgagtggagctgtgtaatgtaattatacttaagatgggacttctgacgaattacagaagaatctttgtgctgtctcatgtctccataaatacacttaactgctattgacagtaatagaagggagtcttgaatatgaaaagctttttttatccttttatgatttctagagggaaaacttaaaagaacaattatgtttttaaaaaagatgtttctcccagtacttctgaatatttgacaatcctataaaatttgtaaaactaaagtaactttaaaagcaaagacttctgctaataaatcccgacttctcagttta

SEQ ID NO: 7515 - DNA, 333 bp, Homo sapiens
  ENST00000472783
gaatagcagggcacagtccgattcatctcagtattccctcggccagcagagcgcttaataaacatcagtggatctgaacttgaatcaaatggcaggtagcagcttgcagaagcctgaaaaacctgggcactgaggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttga

SEQ ID NO: 7516 - DNA, 492 bp, Homo sapiens
  ENST00000471169
agtattccctcggccagcagagcgcttaataaacatcagtggatctgaacttgaatcaaatggcaggtagcagcttgcagaagcctgaaaaacctgggcactgaggtctcgcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaacca

SEQ ID NO: 7517 - DNA, 676 bp, Homo sapiens
  ENST00000480847
tgtggagaaaggagggaagaattccctgatgtctgccgtttatgtgcacatctgttgcagtgggaaggaaaataacatttatggagtaccttctataatagaagtttcctggatcccacccatgagggcgatcctggaatgttgtctcaagtgtggggccaaagcacagccaggaggagcattccctgagggcagtttgaagattcagagctggcaatagaaggcaaggtcctccctaaagcacagcagagcacaactcaaggaagagacgaaaaggacaaaataagaatgagtggcacggttgatgatggggattgctgagaccatctcaacaataccccggcttgctctaagggaatcaggacttcgtctttgaaggaaactgttctggggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaa

SEQ ID NO: 7518 - DNA, 6583 bp, Homo sapiens
  ENST00000511601
acaacggcgggaggctgcagcggtctgcgcgccgggagcgggggcgcgctggccgcgggtttggaagaggacagttgccctttattctggcggcagatagcagcaggtgaaaaagtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctc

SEQ ID NO: 7519 - DNA, 6480 bp, Homo sapiens
  ENST00000260008
agtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 7520 - DNA, 1468 bp, Homo sapiens
  ENST00000485803
ggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgaggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 7521 - DNA, 1647 bp, Homo sapiens
  ENST00000373016
cacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 7522 - DNA, 882 bp, Homo sapiens
  ENST00000475084
ggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgaggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctcc

SEQ ID NO: 7523 - DNA, 1091 bp, Homo sapiens
  ENST00000477194
ggcccccgcggcgggctggggggccgggggcggggtccgggcggggcgggcccgcgctcacttcctcggggaggggttggggccgcgctcccactcgcccacacggtccgtctgcagtcggcagcctcgccggcagctcgctcggcccccgcttggcccggcccgcagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttc

SEQ ID NO: 7524 - DNA, 607 bp, Homo sapiens
  ENST00000483132
ggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctggtatgtgttcaggggctcatcttgtgtgagaactggcatctgcgtagggtctttgcatgtgtctgtctgatacatggagacttggtctgtgtaaagacctgcatacacagcatgtttctggaaatttagtatatacgggatctgtttgcctggtatactcctgggggctactatgtacaggcagattgacacatgtgatacatacttgggggcttagcatgtgtgaatatctgcatgtttagtacaggtaggaact

SEQ ID NO: 7525 - DNA, 779 bp, Homo sapiens
  ENST00000450218
tgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgc

SEQ ID NO: 7526 - DNA, 2031 bp, Homo sapiens
  ENST00000326771
tgcaagtccagagagcagggaactaccttgagtattctactcaaacttatgtctcagagttccccaatttcccaagaagggagagatagaggccacaatccagggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaa

SEQ ID NO: 7527 - DNA, 1904 bp, Homo sapiens
  ENST00000541107
aggaagcaggcagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatctt

SEQ ID NO: 7528 - DNA, 4967 bp, Homo sapiens
  ENST00000257209
agcctgcgagtccgcgagccagcgagctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 7529 - DNA, 4154 bp, Homo sapiens
  ENST00000589114
ctgcgagtccgcgagccagcgagctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtaaatgaagccccttgtttcagtcggcatgtgccagggaggcctggggtgcaggggctggttctctaagagcttgtccacaggctggcctctgaggtgacctgggtcaacccactcatgtggctgtgtcacccagtgtctggggacaaggagtgtggccacgctggcagccagccagcagccttctgccctgtagaaagacagcccccaaactgtctgccacaccatcacattcatcacctccacacctggggaaaagggccccgataaggagggcttttcctgaggaataagccccagaagagaaacctctcacttccccctgactgttccattgtgaataatagtaaggttgataatagtaaggctttttccgtttttgatataagtttagaaactgtcacattgtcatctattcctttaaaaatgtgtttactgaagtgtgttaatcattttgactggacatttcagactgggaaagatttgtttaaatggattgaatgagtatttccaaaaaattgtacacagtttactgaggtcaatttgatgtactggaatatagataatttgttttctatattacactcataactattcttttctttgtataaagtatatgcttttccttatggaagtatatctttttgatgttacacttaatactcattcagttctcctatgaatggtaactttagaattagggaccaaatggaatgttagattataggtttggtttagcctgaaagaacctcaccaaggacttgagaagggtgccacagagggttataggaatcgtgaataattcatatgatctgtgacaccacaggattacttttcctacccatgacttgtgtgctatcaaggtggtagaatgcctccttcctcaacaaacactcctaaccagtggagtcatgtcttatgggccagcctttcttaagctacatatgagtggcacccactcgagtcgatgtcttaggcccaaagggcaatatgacacctctacaaaggcctgccaaccagtgccatgacccatgaatggcttattcattcctagattaaaaatacattgtctcagaagcatggatgaacgaatgaatgaaaccagaatgtcttccaatagacctgtcagtcaatggcgtagtctaaaatagttactatttggattttttcccagttagaatatactactagattttatgctttatattgctggtcactatgatgcagtaaaaacaagaagataaaagactttattagtttacatcttaggaattattgcattgaaaatccagtgtcttcatttggttgaatatgtatgtgccaagaggtattatatatactgatatttacttaatttctttcaaagtcagattacagttagtcccccaaattcttcttatcattcatattaatgtaattattgtcataatactgggtgtagggtaagtcttattgatcagattggtcttaaatcatgttttatttattaggaatagctttaagaattattaatcataactgggtttagcaggcctaaaacatatcaagaaattggattagtaaaaatataccaggcgacagggctttcttggatcagattgtccaatattcttccaaagaaggacaattttccaaaagtggaaaccgttcccagtgaagaaccactgactttctaccaaagtgggcaatgtccaagtatttagaagcagaaattagggctttgcaatgatttttctgctttgcttcagtgctgttatgagagttggtcatgtttatttactgtagcttattggttcctaaaaaatctcactgctcacaggcatcatcagccactgtggagtccgggcagctatgtcattatagctcttgcttttcagagtgctgtcaaatcacagagcaaccttagagataaaaaattattctcaaacgtatttctaatgattatgtcaaaaatgaatttgtaggacttgaaaaagtctcattccagttatgtggtttaatttttctttgtttaatgtgttctactttagggcatgcatgtgagaagctttatcataacatacattttacttttttgt

SEQ ID NO: 7530 - DNA, 4869 bp, Homo sapiens
  ENST00000590592
atggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaggaggaggaggaggaagaggagcagccaatcacggagcccagttccgaagaagagagagaggatgatgcttcctgtcagggcaaggacagcaaggtcggcgctgcctcagggcagagccccactggaagggatgctgctcccaagagctctgccctccctgctgtctcgaatgccagctcgcagggaaagccgcttctggttggcactgcaggcgggaccacctggcacagtgggtcctctgggtctgaggccaccccatctgccctcctgtcaccccctgcctcagctgctcggccctcctccgccacaccaggctccctgaaggtgtcaccgaccatagacaagctgccctacgtgccccacagccccttccacctcttctcctatgactttgaggactcctccctgtccaccaaggagaaggaagcagagtcccagaaggaaaacagttcctctgattctttctctttgagcacatattctgcctctgagccttaccacttccgatctttctcttctaatagatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatactgatgaggaggaggaagttgagtctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtga

SEQ ID NO: 7531 - DNA, 4518 bp, Homo sapiens
  ENST00000359247
atggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggttta

SEQ ID NO: 7532 - DNA, 3035 bp, Homo sapiens
  ENST00000591635
agtcggctccctcactgcctctggacttgccaaagttttgttgaggtggagaggtcgccacaggctgaaagcattaaggagaaccaccctggcatgcggagcagtcggtgtgctttggaggaaaacatacaaaccagctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 7533 - DNA, 4126 bp, Homo sapiens
  ENST00000592930
gttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 7534 - DNA, 885 bp, Homo sapiens
  ENST00000587493
gtgtgatgctgccatttcccccaatttgcttggttatgagtgacgtgggatttttaatcattagcatcttggctttgctgggtgtttttggcaggctgactctccagccagccctgcactgtgctgtgtgcatcaggaaaccggctcattctgcaggtgtttcatccataaacaagcatcagccacaggctcctctttcgtttgacggaaaccctttggaatttaactttcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggag

SEQ ID NO: 7535 - DNA, 2112 bp, Homo sapiens
  ENST00000592128
cgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 7536 - DNA, 1720 bp, Homo sapiens
  ENST00000585579
acgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatgatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 7537 - DNA, 1938 bp, Homo sapiens
  ENST00000318627
tcccgggagcaaggggaaactccgagaggagggcaacagagccagcatcttgccagggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaa

SEQ ID NO: 7538 - DNA, 746 bp, Homo sapiens
  ENST00000409634
agctgttttgggtttgaaattccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatgcaacatggagacaatgttttcctgcattcttcattccagaagctgatggaggaaaggccctatgagctgtgggctggctctataggccccactgtactttagggaattccagtagcaaaggaataaaatcattttagtcactatgcactaatgtttccgttggtaaaacctctagccttcagttctatttgtacagtctttaatagtcaacctcatttttcttattttgaaaaaaatgttcttccctctaccttgtctttaaacccagtctatttcctgggacaggtctacatcattaaactgcagatggttctttttctattaagcagcaggtatcattcttgtcctgacaggaggaggctccacctgctgccggcccaccaatacttccagctgactgc

SEQ ID NO: 7539 - DNA, 9536 bp, Homo sapiens
  ENST00000333129
ttttgggtttgaaattccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatggcttgaagatgcagtggacgccagagcatgcccagtggccagaacagcactttgacatcacctcaaccactcggtctcctgcccacaaagttgaagcctacagaggtcatctgcagcgcacctatcagtacgcctgggcgaatgatgacatatctgctctgactgcatccaacctactaaaaaaatatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttagaaaaaaaaaatgtaatgaatgttggcacacacacataaaacctgctacatagggaatagagcccctttccagtagagtttaaattgcaaagggtactggggaagatgacgattaagttgcatctttagagtcagggtagatttggaggaaaagtgcatcaaatgagagcttctgatttgaaagccccagatgacagaaagcatatgtggatgctcagttctgttcaagctagacaacactcaccaaggagcaaggtgcaagtgtgttgatttcagaaggacatgaacctcgtgtgttgattccattctgctgttctcgagatttagttgctgtcaagtgcctggagtggtgctttattttttgtttgcctcacaattacattggtggcatgtgctaatataaagagctttaacttcaaacattattggactaaagagatgaacagttgtgttatgacagaaaaccagatttttgccattttaagagcaacagtattcctcaatcctgtctgttctgcagtattaagctaagaacaggtaaaacagggtaacggtaatctggaccttaatttctgcagttcatttcttttaatgttcttgtctgcaaaaactcaggaaagtgattgtgatttgtacagtacctcaaaggaatgtgttgaaagcactatgtactgctgagagtaataggataggcttcaatgttactttatattaaaatgtatgtttacctcaacaattggaaaatagcaaggaaaattactttgaatgtatccagaaaaatactgaagtgtgatacaactgaatatttacagtttaaagtagaaatggaaggatttttttaagttcttttactaattatggggaattaaccagagcagaataattctttatgtcaataactgcaagagttcttagtacattgctccttgataattaagtgaaaatgttcttaaaaggtacactggttaattgaaagctacttattcagtttgtgttagtgtctagacctgtcagccacaagacctgtttaggaccctgaaagtcacagtacctaaaaactatgactgcctttttattgcataggtggtagtggtggtgatggtggtggtagtttgcaagttatctcttaaaactgctgggaatggtgtcattctattcactaatctagcttatagacttgccgtgctgtttgatagaatgcagaggatagcaaccaaaacaaatacacaaataaataaaaacaaaaaccaaccaacaaaccaacttacatacacatatatatatccacaaagaacctctccatctcctccccttctttttgactccactcttgtcagtgcaattttgcttctcattttgaaatctgggctgtagtgctcctgctttatttctacctcagttttgttacatttctcttggaaagtaaagtagaaaattggaagtggacacacacactgcaatgtagcttgccaaacatgttactttgttttcttccatctttcaccgtaaatctagtttccaaagacatcagcatttgtgcttacttccacctcagtctaccagccccacccctacccatggcataagtggcatttttcttaatttcctatttttctcctgctctctgtcaagttgttctttgtatcctttaatgctttatgtgcaacctttcattgatagtgggctgatgtttggcaatgcttctgaactgtcacagagcaggctgtagctttccacagccactgcccatgcataagcagaacagcctggccttttgaatgtattttcctgggttttttccccttttctttttttagtttagagatgcagtaacaaaactgttgcaaagcactggcattttatgtattcaataaataagtgatgtacatttttaaaaaaatttaaataaatgcaatgagaagccccaagaaaggcctttctgttttttttttcttacaaaaatttttaccgatcttatccacaatatccaattctctgaaacacttaacatagagaaagctcatgagggatttcttatctctgaaattttatgatgcttgatctttactcccctttttttattttttatgttgctaaaaactgagcaattgaaccagaatttaatttactgtgacattctgtcaattaaagctgtgcttaaatataaatattccatattaaaaagcagtgcctttcattaaggatacaaaaaataatacttaaatacgccctctgcttttcgcaagtgaataaatgctacaatcgtgttctgggtctaccctgtgcatcccttgtaaggaaattctaatatccacattaacttgtaggttcatattgatctcactgacaagtttacttttgcacagtgctgacctattttctgacttttagacattatatttcatttccgccaacatgctgtgttcacttgaaagcgtctggcaagttttgacaaacccagtcttatttagacaactttggaaaatccaatattgacccacatttttttgtggctagtaagatttaatgccaaatatatgactgcactattgtgttttacactcatttataaaactgaaaataaattgaagtcatacatcttggcttttagctttaagtgacttaaaaattagaactctgagtgacttaaaaattaatttgagatgcaagtggtcaaaaatccatgtatttagacagaagctgaagtcgtatgtgattttcatttagcctcacaaaatccaagatttgatctcttaggaaattgggcatgttgaagaaatgaagatctgttggaggagatatggctgacctttgagtagatagtgctctcctgtgattctttgattctgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaaaaggaagtgaaggaaaccacttcagtattgggatcaatagaaattcaagaggtagttcataatgaccttatatgtgacacaaatggaaatactctacacttctggcatgcttctctcccaaatatttagaacattagtgacaatatgaaaaactttgctgactgagctgatcaatggaatgtgaaggcagtatactttaaggctatttactttcacacagaatgtttatctattagtcagtttgtattctactcaaatgcagatagacgggtataatgttttcttgtgcatttgaaacctatcaaggagaaaataaaccattccactaaaatacataggccaaacaccatctgggaaagtgataaaagctatccagaggctatgctatgtaaaatagcaaggtcaatttacatgggttgcatagtacttggctatgcagttttcaaaagaacacatccaaaaaaaaaaaaaatccaaattagttcctataataggtctttgtaaatttaaatatatttgtgggttggaaaatacgtttttagagacatttagaatttctttctctaaaaatgtatccaactccaagcagaaagagacttctgtactcacattctcatgtttcttagaattgggtagcatgatcattgaatctgtattttgcaaagtgaaagggacgcagcttgttgaactattgaggccactaaagtaaagttctaatatatatatataaatataaaattagtgtgtgtgtttgtatgtgtgtatgtgtgtgtgttctttcatcaccacctagttgaactttaaaacagacgtctacttttcattattcagaagcaacttgttacttcctttcttcatatgtgcagagatacacatgatcatgttacaatttgaagtgttttaatgtgtttttttttcttttgaaacgtaaagccttcagttgttgaatcatctgccgatttttatatgaagcacattagcaaacctggagctattagtatttcagaattcacaaccagctgtacttgtgactaaccaacacatgaactgaagctcacactttgctaagacctttggttgacattcgattttgaacctgccagatgcatttgtgtgaaccagggatactgcatctttaatgaacaagtctctcctctttcccctgtttttaaatacaacacaagcagtgtagcactaggcactgcaattgtcaaagacaattagactggaagcaggaaaatttcacctccctgtctcagtgatatgtagaatgtcggcagcatgggtcagccttgccacagagttgtgtgagaatatatgaatcagtcctatagaatgttaaatatttataaaatggttctgtagtacaccaaggttgggagcacattcattccttcttgttgtcttatgatacaaaaaaaaaaaaaaaaaaagcaaaagtttatttctgggcttaaaactctccctctaatatctctctctcttttacccccattccccaaccattcttctctccatccctctcctctcctcttcctctctcttctctctctctctctctctctctgtctctaactctcgctctctcttgtatgtgggtgtgtgtgtgtatgagtttccactgtggattatatacacttgctagagaatattcatttcttttttttcttttttcatctgatgtatattcaaacattgttctttataaccatttctacctcattgctacatattgtacatgtagtatttatttgttgtctttttttgaatgtcatgcatttcgtaagaaaaagacttgtccttgaacttgaacagtctacctcagaaagactgtctttacactgaacagtattagcaacctaaatgataagacgcattagtgaagtgtggcagggtagataatgcacgagtacttgggatactgatggacttttaattgtattcataacacaagactgcttaaaagaacttaaaagaaattatgcactgtgtaggtcttcatcgaggtcccatttgggacattatatacagaatagagctttattcctatgtgcccatctctgagaaatgtgttagcattcccaagtattttacactggcaatctggctacttaagacaaacaaattcaaacaacatttttatattttgactgacaccctcagctcctaaatttaagagaaataatggtacttaactattttcaactatagtcttcagtgattgaaaatgccttcattttaattctgtgactcctgatataaattaagaaaaacaatgcagttgcaagggcctgcacaacactgaaaataaaccaaaaattaaaaatggcacttcccaaaggaattaacaaacgtggagtcatggtgcttgcaagttccataactgaaagcattttgtttctgatttccctttataacatgtatttgtttattgaagcaattgtacaactaatggcacattgaattactttgtatgaagtgttttatattatactatttattttagcattcgttctttttcttcaccagctctatattacagtagcaaaagaacacttagttttaaaaaatgctgaaaggggttcaccacccacccaatcgatgaatggacttttgaagttgcttgtcagcaaattgtggatattttacaaaagcaaatgaactgtgacaatccacaactcccacagatgtgaattcagaaatgcatctgaaactccggtatgcctgacaatctattctttaagtttcattaacaaagtggcatccaatcctttcacttacaattccttgcaggaatgtattgtctagaggctgtctagtagtgattaagagagggtttttgttttgttttatttgtttactgtattaggtgaggaatgccatatttcttgtcagccaacagtacttgtctgagacagaaatttaaaaaaagaaaaagaaacctaactaattaaaatttctgtgcactttgcttccctgaccatattgattttatttgcttaaattgaaacaatacgctggatttgaccagattttgaccccttgaaagaagaaaagccctatatagtacatgtttctttgggttattctagtactgtttccttatttgttctgcaaatttcaaatcatttttttgtgtgcattattttacatctgctgaaactaaatgtgttattattgcactcattaaaaatgaaacaatccatttctcttggaaaaaaatgacaagctttagatgatgaaagcttaaattatccatcacttgcaaaatgaattcatataatttgtgaacattattaatgtaaatgagacatttctgcttagattttttttattttgatgggatcattatatggttgatcatatgtgtgtaggaagctgctgtacaattaacttggagatctgaaaatgctttttgtcctcattgttgcagtttcaattgtaatccattgcatctcattttcttgggtgttggcactgtaatatattaaaaaaaaattcagtgctcagtattgtaacaactgtccctactgaatattccttttcataaatacttgctaccacagggaaattaagttttcatatagaataactagtttcagtagtaaccattgaagaattaaaaatgtggttcaaggcagatatttttatgaaaagttttctctattgtaaaatttgttgtatatggctatgctactatcatggaataagaaaagaacaagcatacctcaaataaaaaaaaattctgagttaaaaaaa

SEQ ID NO: 7540 - DNA, 600 bp, Homo sapiens
  ENST00000482917
ggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggcttgaagatgcagtggacgccagagcatgcccagtggccagaacagcactttgacatcacctcaaccactcggtctcctgcccacaaagttgaagcctacagaggtcatctgcagcgcacctatcagtacgcctgggcgaatgatgacatatctgctctgactgcatccaacctactaaaaaaatatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacag

SEQ ID NO: 7541 - DNA, 567 bp, Homo sapiens
  ENST00000476723
gcattgttcgggcgactctcggagcgcgcacagtcggctcgcagcgcggcactacagcggccccggcccggcccccgcccggccccggcgcaggcagttcagatcaaggaggtatgcaagcagagaatcccagcacggatccctaaaccgaaatctacaggcatcaccaagatttccactaaagcccccacagtgcctatggataagcctatttaccaaaatggctgtgggaagctacacatcgtgagaactgtcacctccaacaccttcctccacgtgggagggagaaggtaactcataccaatgcactgcctggatacattcatctacagaaatatgtggaaagctaaaattaccactatgaaaggccaaaggaccatctctccaggaaatggtgaagcagctttgtggacctgatgaagatcatcccccaaaaagcagcacgtctacaattattttacttctatatgtgtatatgcacacacaaacactcgcaggcctagacccacacccaaatctacccatttcctcatccgacatataatctaacccaaagatgaactatct

SEQ ID NO: 7542 - DNA, 445 bp, Homo sapiens
  ENST00000477258
ccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacaatcaaggaggtatgcaagcagagaatcccagcacggatccctaaaccgaaatctacaggcatcaccaagatttccactaaagcccccacagtgcctatggataagcctatttaccaaaatggctgtg

SEQ ID NO: 7543 - DNA, 3970 bp, Homo sapiens
  ENST00000354552
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagacttttaaggcattccaaatcccagtcttcatgttgaactgggttaagcatttattaaaaaatcgttttcttcta

SEQ ID NO: 7544 - DNA, 2321 bp, Homo sapiens
  ENST00000487087
ttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 7545 - DNA, 2854 bp, Homo sapiens
  ENST00000471562
ggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 7546 - DNA, 4219 bp, Homo sapiens
  ENST00000331335
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 7547 - DNA, 2898 bp, Homo sapiens
  ENST00000495625
acagtcggctcgcagcgcggcactacagcggccccggcccggcccccgcccggccccggcgcaggcagttcagggaagcccaccataatgagaagagcggggccaacacccatgtcactgtggagaagtacagaatatgcaatggaagagttgtttatctgatataagcggtaattggaaactgaaaaattcctgctctggaaaaaagatattctgctcttctgaatctaacagaggaagagacaaacagaaaccatcaattattgtttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccct

SEQ ID NO: 7548 - DNA, 1712 bp, Homo sapiens
  ENST00000398326
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagatggagtctagctctgctgccgaggctggagtgcaatggcatgatcttggctcactgcaatctctgcctcctgggttcaagtgattctcctgcctcagcattccaagtagctgggattacaggcacccgccatcatgcccagctagtttttgtatttttgtagagacagagtttcaccatgttggccaggctagtcttgaacccctgacctcaggtgatccacccacctcggcctcccaaagtgctgggataacaggcatgagccaacgcgcttgacttgcacatatatttttaatgtgtgagtgggtgcatgtcataattccagatggaaatttgtcaccacaaaacataatttttatttagctgatctttccaggtttctatttataatggaatgaaaagatgaagttgggcttatgaatcaagacaaacacaggccctggtcattgtgtaattccatatagtataatttgtttgcaatctttcattccatacacctacaatacagctctaaaaataatgctacctacaatataaagatatactttttttccaaataaccttcaaaaatgtcaaaatatgcaacaaaaatattgtatcatatctaaaccctcaaataagctacatttaaaccaa

SEQ ID NO: 7549 - DNA, 336 bp, Homo sapiens
  ENST00000468533
ggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacgatgacatctcctaatctttcttcttcgaacaagaaaaaaaatggttgccaacagtttgaagggaaaagaagataaaagaaaacagagtctgccatcagtgggtataggagacagttaaaaaaaa

SEQ ID NO: 7550 - DNA, 3280 bp, Homo sapiens
  ENST00000383694
cataggccgggcgcgctcagcgccccgctcgcattgttcgggcgactctcggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttatttttaccatt

SEQ ID NO: 7551 - DNA, 2450 bp, Homo sapiens
  ENST00000317811
acagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggccccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataa

SEQ ID NO: 7552 - DNA, 851 bp, Homo sapiens
  ENST00000532914
gcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaaggg

SEQ ID NO: 7553 - DNA, 3732 bp, Homo sapiens
  ENST00000001008
gagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaccctttctgttcagccttggagtggtgggtatgggtgggtacataatgggtagtagcacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacacttaggaagacgaaagtataaagatctagaagactgggacaccatgcatgttcattttgaagttggaattggtcttctgcctacctctgatctggcagaggtatctgcattttggtttgttaacaaggtaaaactcctggtgtcactgacctcctcctgtcagataacttacatgattaaggttaagagtaaagcagagtgttcacgtccagcttccttctcagccttaacaggaaaaggcttgtgctttttttctaactatgctttgacccttaactcctatggcatgatggggccctgggagaagccaggcagcacaagccagtcatgctgagctgcctccagataatcctggctccaggccagagcccgtgtctgccctcatccctctctcctactgtgagctctccagtcctttcccaacagcgatgtggttgtctgcttagccacatgcctgtatagttccttccagaagaaatgtataatggtggaagatgtatttctgtgtgaaaattttcaccaagtcatacaacacagctgatgctggagccaggattaaaattggggtgtacaagtctcccagtgtgagtatcccttgagcccaagacaccaaggatgcagagaactgtgactgtgccactgcacgccagcctgggcaagagagtgagaccatctcttttttaaaaaagtccctgtgtaactgctttcttactgggcttacctcacatcacagccctgtgtttgtggtttgtgtctgggtcctcttggtatttcaaaagtagtagattcttacgcctgcagccaacaataatcactaactcaagcatttatggagtaagcctagcactgtactgacagcatcacatgagtgaaactgaatccttgcaaccatcctacaaagaaggtataactttaataaccctatttacagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgaggatgttttgttaaaa

SEQ ID NO: 7554 - DNA, 425 bp, Homo sapiens
  ENST00000543769
cgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtgacttccccttctcgctccagcgtcctgccgttttctacgagattgttattccaggtcatcaagagagagggcacaggtacagagatgcccatgattggggaccgagtctttgtccactacactggctggctattagatggcacaaagtttgactccagtctggatcgcaaggacaaattctcctttgacctgggaaaag

SEQ ID NO: 7555 - DNA, 777 bp, Homo sapiens
  ENST00000540260
cagcggagctgccagccgcgggccgcctcgttggtggcggtgccagggctcgcccacccgggcggtggaacacgggccaggacggggagcgactccccacagtgctttcctggcccttcggcctttgtgcgacgcaggcgcgacagggttccggcgccctcccggggtcccctgccgacgccgggacccagcgaggtccccactcgccgcgcggcgccccctccctcggccccggggaggccgggcgcggggcatgccgggagctgtagtcccctcccccctccgccgcctcccggagccagggctgcggggtgtggggcggggaggaggcgctctgctgtggagcctgccgccgagtgaccgctcgactacaaatagcctggggagctgcggggagggcatcttgacctgggccaggacaacctgccttgggtcggagcaggttccagggagaatcagagatggtgaattcccagcctgcgtcttatgccttctccccatccgctgctgcgtcctcatcctggcttcccaccgctgagctccgcgtgtgcggcacccacctcagggggcctttacctggtccagaagtgcatctgtctttgcaccagattattggggacctcaagcgtctgctccagcggctctcctgtggcatgtgacttccccttctcgctccagcgtcctgccgttttctacgagattgttattccaggtcatcaagagagagggcacaggtacagagatgcccatgattggggaccgagtctttgtccacta

SEQ ID NO: 7556 - DNA, 572 bp, Homo sapiens
  ENST00000538622
caaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgag

SEQ ID NO: 7557 - DNA, 727 bp, Homo sapiens
  ENST00000543037
gcagaatacagactcgcggtgaaggctatgctaagcccaatgagggtgctatcgtggagggtgagacagtacagtctgggctttcaattctcattctgatatttaggccttgtgtggctttgggcaagacacttccgttctccgagcctatcttcttgtccataaaatgaggggttggaccatattctcttcatatcactccagatttgagaacacaggagaatcttgggatgatgggggtgatgcagggaggctgatggcatccttcctcagtcacctgccctcttacaactctggtacactgcctctctttcatgccagttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttc

SEQ ID NO: 7558 - DNA, 370 bp, Homo sapiens
  ENST00000539181
ccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggcgccgtggctcacacctgcaatcccagcactttgcagagccaaagtgggaggatcacttgaacccagtaggtagagacctcagtgacttaggatggcaccactgcaccccagcctgagtgacaaaatgaaaccccatctcaaaaaaagaaaagcgagatgctttttgtgtgtgattaaataaataataca

SEQ ID NO: 7559 - DNA, 287 bp, Homo sapiens
  ENST00000544366
tgaaggaggagcagaagagcaacacggcagggagccagtctcagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgagga

SEQ ID NO: 7560 - DNA, 156 bp, Homo sapiens
  ENST00000630279
atgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtga

SEQ ID NO: 7561 - DNA, 3772 bp, Homo sapiens
  ENST00000357266
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtga

SEQ ID NO: 7562 - DNA, 3940 bp, Homo sapiens
  ENST00000536438
agaacaaactcctacctctgtttgcaactaagagttacatcccccatgccaagaccttccgaggcgtcccagagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 7563 - DNA, 3827 bp, Homo sapiens
  ENST00000539068
agtctcgggcggcggtgtccggcgcgcgggcggcctgctgggcgggctgaagggttagcggagcacgggcaaggcggagagtgacggagtcggcgagcccccgcggcgacaggtaccggcgccatggccacggagatggggcggccggccgcggcgccccgggagccgaacgccctccttccaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 7564 - DNA, 7384 bp, Homo sapiens
  ENST00000542713
gattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctc

SEQ ID NO: 7565 - DNA, 2577 bp, Homo sapiens
  ENST00000608303
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 7566 - DNA, 561 bp, Homo sapiens
  ENST00000527767
ctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgagg

SEQ ID NO: 7567 - DNA, 4127 bp, Homo sapiens
  ENST00000527786
aggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 7568 - DNA, 3130 bp, Homo sapiens
  ENST00000429175
caacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcag

SEQ ID NO: 7569 - DNA, 3859 bp, Homo sapiens
  ENST00000534087
aacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 7570 - DNA, 620 bp, Homo sapiens
  ENST00000608055
gccctgcaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcaggtaattcgagaaccaggctgcctgggcgccattcacttccccactctctgggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctact

SEQ ID NO: 7571 - DNA, 5370 bp, Homo sapiens
  ENST00000528790
tttgtttttaagcaagaagaatccctttagaggaggaattaggaaagaaaaaaaagtcaaacagaaacagaaggagtggaggtttgtctctctcttttgtcccctgccttgcccttcctccctatcccatccccctcactttctgtgttgcttttcatgccagttgctaaagactgtaattttaaaactgaacgggcttttccagagccttgaggaatgtgcatctgcacgtggatttttccacaaaaaaagtgtccctgtcttttggatcttcttagccagaaacaatgaggccaggcaatcagagtccatccgtcttcccaactcttattctaatttgtttgagaggctcagaaggggctgaagggcatggttgtgtttcaccccgtcagactctgttgtttgatgaggtttgtgctccatttgttcggatggtttttatggtttctttgttgttcatggaataactttgaaggtcataattctgtatcctcaagctcctctgctattcctgctcaatgtctcaatgggactcataccaagagaaagggaaggaagaagtttccagctagttagttaagcaatttctcaacacatttatggaagcatgtggaatctttcaagaaaggggttacgatcacaaaagttcgatttgaggagtattctccaagacaactgagaagcaagcccttagtcatgcccaggtggggagcaggtctccaacctctcatttcctgatccagcccctttcccagccacatttctggcctcttccctttctctgtggtcatcagcccagccctctccactatcaatagaaaagcccgagagccctcagagagcctggaatgtgctcccaccgctgtgatgtcatcccacatcatccatgtgctgaaatcagggactggagtcggcccccaggaatgtcatggccatgggctttgagacactcttcttatgggcctttcacccaatccagaccttgcctgctcttcagagctgcttgaaggattttgctacagaactatggacatttaagaaatgtctaaccttgtgtcagtttatatttgtagaacgcttcataaggtgcttttccatatgttatctcatctgatcatttccacaaccccataaggtagataaaacataaatttttatttccgtattaaaattgaagcccagaggagacttttgattcatcccaggtttcacaacaaagagtgtcaggaagagaacttgaaccaatcctctgacttcacattcagggttcttcccattactttggctcccagataagactacaatcttctgaaagtcagagtgttaatattccaaccccagggggtgagtacacttccagaatttagggatgctttaaaagccattgctgaattgaattttatttctcctgatcactacagataatgctcatgcaacttttctgagaagcaggcgatgctaatgtacccctatttgttattgttcattagacccttcttatgactcagtcagaagaggagcttggggcaataacatgaattctggcctcaacaaaagtaagtaaatgttttatagttctttggaggaaagcatgtttctgaggacaggattggagaacaggatcatgagacacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttctgtaccaatgaatggtcactgtcactgggttttgcttttgttatttaaatcaagataatgactctctataattttgctcccgtaactgttgaggctaagtcgtaccaatttccccattccccttgatactgggtagatttcctcatatcatcatctcaccacttggtggagaaattgatgtctcagaaccctgccatctcctcaacaggttatcttctgtccctgatgaggagatgccggggggtctgggacatcaggttctccaccaagtggtgagatgatgacatgtcgaagtctacccaatatcccccagtaagagaataaggggcaagaatgactcatgaactcctgtaccagaaatcaaacttgccatgcctaggaagcaaaatatgaagcacatgaacaggtggtaaagggaattctttcaagaaagaggttggggttacaaattaatgcccaaacaataaccaagaccccttccaattatgtgtattaattatttacttactctgcacatgacatttggcaatataagattcacaaagatgaatcagacatgcactggtcccataagcgggagagagaaatcaagcacacacagaactcctttcttctggttggtatcaaggaaggctttgtggacctggtagcacttgagttagctctggaaggagaggcaggatttggacctgtggcgatatgggctggggaagacatgagcttggcatgtctgacagtcagtgaggacctcaggttcctggagcttaggatgtgtgatgcagaagaagtctggaaaggtaagaaacagaattgtaaatgatgctatgaagatatgccttagttctttaggcaatgaagagtcactaaggttttgaacactggcgtgtatggtgggttgtggggagacagaagagtaatgaggacaccagtcagactaagccagaaaccatgcaagaagcaatacagatctgtgatgcagaagtgatcatgggaatggaaggggtgtgtgagagataccaaggaggaaactcacaagacagggacaccaggaagcagctgatctttgctcagatgtcactttctcagtaaggacttctctaactttccgatttgaaaatgaaatccacagcctcagtaccatcagtgatgctatactgttagtttactttttaaaaatttgaaaatgaaaaggtgacatttaagcaaagacaaaattttaagaatttaaaaatgtgtttattattgtctctcccattggaatgcgagttctaccaggaactgcttgttcattcctgaatctccagcctggagaacagggccagcacatagtagattctaggtaaatgtttctaaaataagatgaataaatgagtcagtggagagtgggcgaaggaatgagtgagaaagcacatctgtcaagacgtcttgctcccctcggggagctgggtcctactcactgcatttctttccctcttgccacaggtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 7572 - DNA, 3427 bp, Homo sapiens
  ENST00000344954
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 7573 - DNA, 4151 bp, Homo sapiens
  ENST00000281428
agagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 7574 - DNA, 8079 bp, Homo sapiens
  ENST00000490882
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgagctgacgacacggattcccagtcatggcgcagccccttgaaagccctttcagagttctttaaaggtgacccgaagggtgactttaataagacaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctc

SEQ ID NO: 7575 - DNA, 9463 bp, Homo sapiens
  ENST00000295956
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 7576 - DNA, 9391 bp, Homo sapiens
  ENST00000358537
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 7577 - DNA, 9430 bp, Homo sapiens
  ENST00000429972
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 7578 - DNA, 7402 bp, Homo sapiens
  ENST00000493452
atttttgaatcacacaggatgctattctagactttttagatatatccaggaatagagtaaaaaataaaatccctcctgcataaaggcaccaggctttttccaagctttgtttattttttaacaccacttcttcaaggaatggataatccccatcttcatgcaagaacatagcacccggaggagaagtctcagtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaa

SEQ ID NO: 7579 - DNA, 6497 bp, Homo sapiens
  ENST00000481470
cttctaaaattgcttacacctgcctcatctgctttgcttaatgagcatgccatcctttgattaacctaccctggagttgacccatccttgactgtcacgttggaagctgggatctggactctgcaacccaacgcgtgccttgattatgttttagcataatctctaacatctccacaggcttcaccttgagggtccccttgccccatgagattggcaccctcacctgccctgcacctatgccccagcatgctggtaccacagtgttctttgctcaaaggtggccacaagtcttgactagccagcccattggttaatttttgctcttcacaattctggactctttggcagtgtctcagctgtagagtaaaattgccacatcctaagcgtgcctaaccagcttgaaaggttatattgtgtcttcaacacacatcatccacatacaccctccagcagcaagcacaggcagtctccttaattatactctagggcagactgagtgtattttagccaacaaaaagctaaaggtgtctctcggggtcatttctgcaaccatgaattggggatcctgtgatttttttcaggcctgtgattatggttgctggcctttttgttactcatcagtggaaaccaatagctcttggggatggatgtggtcctatttcagactcagccaagggtggagtaaaggtgaggccaggcagctccttaaacctctcatctctgtcctcaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggtaacgaacaaccaccttcggagttactctcccttcctggggagctggttgtgtcagatcaatcatagtggaaactatggatggttttagatgtgttaaagctactttgaactttgaatgtcagtaaatagtatgagatgtcagagggcagtgtttgaaacttacaaaagtccacagagtggagccgtgcagaagttgagaaagcatgttaggatgttaggtggttttctatctctaacaggaaagaatacatattgaaatcttacgtatttgtttagatcagggtctgaaaaatcccctgatttctaattttcacttgaaaaataatcaaaaagttttcctatacttataaaaatgtgtctcctccaaaacactggaaaaaataccaaactatgaaaaccacttcacagccaccacccaaggtaaccaccataaacactgtagtaaatcccttccacacgtcatgattcactgttacataaagaatgtaggttcatcgcaggaaaattagaaaattcagatagaaaaatcatcctttctcatccacagaatcattttttgatatttcattatatgtcatcccaaacttttacactgcttatacatagactattttatgtcaatagaaagatgtgaattccacaggcacatctttggtgggtagggggtggggggattgggagggtccttggccttgtcagccaaggccagactcatccatttgcccagaaagccagatcctagttgtatgggggtgggatcctaggggtttagaagacattatgggtgtgagatacaggtgtggtggcttttgtgttggggtgcgcgggctctcctggggttactgtgtagggtactcgcctgtcctctggctgagagacccctcttgatctggccattcatgcctgtccccctccctcctgtatcttaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 7580 - DNA, 475 bp, Homo sapiens
  ENST00000491408
tccctttgcccacagctcacgtggagtgcgtcaatccattgtccccagcatcagggctgccctggatgagttgttaaaaggaaactcttaaaacaaggcaactctctccctaacacccctgcatccctgttcccacttgtaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattg

SEQ ID NO: 7581 - DNA, 2058 bp, Homo sapiens
  ENST00000477629
tgtggaaatgaagcatctctttctgttttctctttgagatggtttgagttagattgtgtctcttccaagcttgccacaccccagtgcctccagtcatctgctttcttgaaggatggccacgctggtgaattctagacaaattctaacccggggagagggctggagaatttctggtcctggttgggagatactccctgttaaaccttcggatatgctgacctagctgaggtagccaggggctatttaaaaattcaaaatctcagatctggctgtggataaacccccaaggtggtacgtgcagtacttggaggcgtgagggcagaaggtcctccccagcagtttgtacgggacacatcatctatgggatattagtaaatatccttaaggaaaggcttctgtggtcaaaaccaggttcagcaggttatttcactatggggcttctcaggacgcttaacctactcatccccctctgggctttgcaaacgaggccgccattgctttctttctgctatgtagaaatagattgaggcgtaagggtcggatgtcctttctccattcatcaggctccctcttcctgaggagctgctgtcagaacagcctggggctgctgtgttgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtagatatgcttttagatttttagattaactatctgtcaaatagaatcatgtcagtgaaagaactggccctgccgatgccagggtctggaagtatttaagaggtggcagcccagcggcatccttctagtatttctctttcattcctgaaattagaacgagggctgtgctgcagaactcgctgggccacatctagccctttggtggtgaattgttcttcttgggccccgattagccagtcaacaggtcacacagtctgtctgaaatgtgttccaagttctttctataaagaatccttccagagggaagccactgtgagtgaaaattttgaggctcctctgcccagaagttggcatgtcctgtggaattgcacaaattctacagagaagggaaatctaaatcgtcttcagatggagcttgtgttgcgagctctggagagggggttgtctttctacactgcatctcccatccttcctaacgagtcacggagctgtcgactccgccttcttggctttagttaacaggttcttcttgtgtagtcacatcaacgtcgggtcacatgggaatgtggtaaagcctcattactgtagagttcagacatgatcacttaaaaagagctttattgggccgggcgcggtggcttactcctataatcccagcactttggggggccgaggcaggcagatcacctgaggtcaggagttcgagaccagcctggctaacatggcaaaaccctatctcttctaaaaatacaaaaataagcagggcgtggtggcgggcacctgtaatcccacctactcaggaggctgaggcacaagaattgcgtaaacctgggaggtggaggttgcagtgagctgaaattgcaccgctgcactccagcctgggcaacaaagtgagactccttctc

SEQ ID NO: 7582 - DNA, 404 bp, Homo sapiens
  ENST00000466455
cttggcggtggaaggccccagcaaagtggacatccagacggaggacctggaagatggcacctgcaaagtctcctacttccctaccgtgcctggggtttatatcgtctccaccaaattcgctgacgagcacgtgcctgaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccag

SEQ ID NO: 7583 - DNA, 315 bp, Homo sapiens
  ENST00000470231
ttcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccaggggtcagagtcatgaactgctctgcccagatcctgtggggctggagggtgcagtttcatactggctctaggtgatggcagtgctccgtgccccgcatgcggccgcctggcctcaccacggcagtgcaggcacagtcgttggcatgacaaatcaacagcagtgatatgtcg

SEQ ID NO: 7584 - DNA, 573 bp, Homo sapiens
  ENST00000468939
agtgatgcttaggaaacttcagcaatggaccttggaccttgcttgggttctgcttggggttggagaaagaggaaagggctagcaacagacgaaacctagcactgcaggtttgaacaaggatggaagagggacaggggctctgtggggctcagtcactaaccaggtttctctttgctctcagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccaggtgag

SEQ ID NO: 7585 - DNA, 541 bp, Homo sapiens
  ENST00000475487
catcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtaacccactcttctgcttcttgaagccttaactgaaccagctccagggaccaagccagatggaaatcctcaagccccatgaaagctttttacacgtactccccgtggaaactggggtcatgcacacttcggaggcgcttgctgtccaaagctgttttgggagttgcggtttgacccacgat

SEQ ID NO: 7586 - DNA, 932 bp, Homo sapiens
  ENST00000484981
cacagctgcagtgtgcatggaatgaaaaggtatctgtgcttggccgccagagcgcccagtatcctgaccttctgaacaaagcaaacctccctctgtttttaatgggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctga

SEQ ID NO: 7587 - DNA, 2002 bp, Homo sapiens
  ENST00000419752
ctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtgggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgg

SEQ ID NO: 7588 - DNA, 33679 bp, Homo sapiens
  ENST00000330753
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaaatgacgcaggagggcaggaataaaagaggtaataggactttcgtattctcctatcatgaatatgacttgcatttctaaaggccatttgatcctttttgtgtgaggagtttatatgaaatcctcatgttcttttaaatttcccaactaaattgtgtgttcctacgaataccttttaggtatgcacacatacacagagcatcttattttatactggtgaaatctatgttgtttaggatacagataatgtcattgtatttatcctatcagaataggcttttcccctatttcaaaatagatgctattggctttattttttatttttaaattttttttaaacacggtcttaccatgttgcccaggctggtctcaaactcctagatgcaagcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaactagtattacctgtttgtagaatctctgttggaacattgactatgaaagacagtgctaacaagtaattcatattacttttggggattttatgtaaagtaacatctatgctattcttgggtacttttgccaagagttacagaccttattctatacagactaaaccattagtcaaaaaataccattcattcaaaataattcattaatgtcctcctactctgttccaaacactaggctgagttcagaggcctcacagaatagtgaaatgcgttcttagccaaatcaggcaaatcttctccctcactatgtccctgaagaaatctcttcatctgatatatttactattcatctactttctacagcactatgttagggtcttccggggattcagagaaaagtgtctgtgagccattaagaaactcacagatcaggtaataaacactttttctaatgcattccagtgtctcagagcctgcataatcactttatactacttcattaaattgacaggacatctaaggtgacaaaagagatgtttctacctgttggtaaggttgatgcaactgtcataattagatgttcttggtttttaatagatgcagcaatgagagagtacattgctaaagtcagaacttaatttgaattaaattttcaagtttccaccaagtatttgaaaacttagaaattgtatttcgtaattacacatgcagacatttaaatttttattaagcaccacgatggaactcaatctaaaggaataatggcacctgataattactaacaacctttgtttatataagaccttgtgcaaactgtgtgataacgtatgtttgcattctgtctttaaaataaccctgtaaggtgcgttattttaatttttagattttaaaacttagcttcaagagaaattaagtgattagtctatagctacaaatcctgtaaatggcagagtcaggaattaccactgagcatgactccatggactcttaattgttttcctgcctcttaataaattgaccatccttgagactgactagccttcagatttttcatgatggagctatcataacttctcagtggatacatatattatcatttatggcaaataaagggaacattttagaagcctcaaaattcttgtcttttaaagcccttggtcatccattcctattttttataaaaattctttttgtgattatttgatggctgcacatttatctgatttgaaggtttcagatggaatcaagatatgtctgtacccatagggtgagctgaaagagctactaaaaggtcttcagttgggttatttttaggaatgaatttgtttcgtacttgagatgttgctctaagtattttgtagattccgctgaaaaagcacgtatgtcacaatctattagggcattagtaaactggcttctgaatttatgctctttttttttcccataacatagataaaaatgtgtgctttaggggatattatataagctttattttcactggctctactgaaagttaaggatacaaaagtttttaatggtaataacccaaactatatgtcattttagcacacacataccaatgggtgatcatatctgtcttttttttttttttttttttttggtatgaagtctaaactagacgaaaacctcaatatatccttaggggaattcttattacttcaatgacataataaacctcagtattgggtcactcttttcctaatataaaaaactatgctggctcaaaaagtcttctaaactccctagttgggataggatgggcctttgttggtttagttttgatttcattcagcaaatatttaccgaggcctggtaagttctggtgcagaataagaatgttttccaggagagttaaattttgctcatcaaaaatctttcttggaagctgctggtttttaaccgtcagcctgggctctttctgcctctttgctttttttgagcagaatatggccaggctggtctcaaactcctgatcttaggtgatccacccacctaggcctcccaaagtgctgggattacaggcatgagccacaccactgcatttaaataatcagcctaggattctgctagttccagcaccagagtggcctctcaaatgtgttttctcctcttggttccctgactctgacttggttaagacccttcctttagtctttttctaatttagcctttccaacacattgaaggacaaagggtaatcataatctataaggaatgcctgagtacgatactgcagtgcttgcaaaacatgcgtttttattgcttgcaagatagaattcaaactctttgtgtgacttatgtatcctactacatgttgctccctgacatttcttaccaatattgcctcctccttcattacatgctctagattatatatatataattacatatataatctagattttatatatatatatatatgaaatgagcaaacaaaatgctttcagtttatcttcctgggatctcaagttccttcaaaccactatatatgtgctcaaggtctttcatcctgtgacattcccctttgcctgatgacatatttgtcctttaagatacaagtcaaagacctctcttccaaagccgctggaatcacacctgccaattatctgaccgctttgtgcggttaatataactttaaaatacatttatttttagcacctatatattgtaattttttgtgagtctgcttcatgcctatacaatggggcccctggaaacagaaaacatattctgtaaattgttgtacctcatccagtgttaagagccatgcccaggccctggtgggtgcccagctacaggggaagagccactctgtcagttgcttatggccagatggctctttttttaatagccccagaaagagctgtggagttctgacttgtgcaaaattagccttgctcaaagaccacagtatgcgttttacaagaacaaacaaacatatatattttccttaaaatctcttgattactcatcaacatttttaaaagaaattttgtttttatgattatttggtggccatgcatctgatttgaaagctttagatggaatcagtatgtctacattcataggatgtgctgagataacaattaaaaagacctgaagaacatctttttattttatttatttatttttttttgagttggagtctcactctgtcaccagattggagtgcagtggcacaagctcggctcactgcaacctccgcctcccgggttcaagcaattctcctgcctcagcctcctgcgtagctgggactacaggcgtgcaccaccatgcctggctaattttttgtatttttagtagagatgggttttgccacattggccaggctagtctcgaactcctgacctcaggtgatccccccacctaggcctcccaaagtgctgggattacaggtgtgagccactgcgcccagccaagaacatcctttttatatattacagacaaactcaaaactgaaccagcttgcagaaaagcatacaaagaggtatctttaaaaatcaccttaatcccagcactttgggaggccgaggtgggcagatcacgaggtcaagaaatcaagaccatcctggccaacatggtgaaaccctgtctctactaaaaatacaaaaaatttagccgggcttggtggtgcgtgcctgtagtcccagctactcaggaggctgaggcaggagaattgcttgaacctaggaggtggaggttgcagtgagccaagatcatgccattgcactccagcctggtgacagagtgagactcaaaaaaaaaaaaaaaaaaatcaccttgcaacaaaatatcgccatcatgaaaagtccacaaagcacaagtagacacaaagttaaacatttcgacagtcggctagtcaaaatgaattctttgcatgtgaaaagcagagattttttttttttcatcttcatcagcaaaattaaaaaagacagtcattattcactatgtcatatcccatataaaaatacagcatatatcatttaaaggttcacattgtgttatcttggttattgccatgagaatagtctttcctagaaatgatatgcttgtaaagaagggagtggagagtggtagttattaagaaatcagtttgaaatcaagctgacttactttggaatcctgcttcaaccactgacctgccaatttgccttggcaataacttgcactttagggttatcagtgtacttttcctaaaatggggacaatgatgtctaacacatatggtggttgtcagaattaaaggcatatatagtagttgacagagtatctggtactgagtatacattgaataaatgacatgaagcaccatgtatttttcatgcagatgtaattcacaagcacatggtgacaaattgccagctttttatgatgaaaatcaaatttcttgtgtattggggtaagaattacatgtagagatgatctatttaaaggtaattagcattcaaaattcctcaaaacactcaataatttgcacagctattatcaagatgggtctgtcagaaaggttttcattattctgtattctttctgggggaaaaaaattgggaagatgaggtgccatgggataacacacaaccatggcaggccttttttctcatggtgtgtgggatcattgaacaacatggttgaacagaaagagaacagacttctttataatgtagcatatattctatctggttgctagagtacacatagatgtagttattgctgaaaattaattcagaatatgtgggtgtcaaaagagccccaggaatgagcattcagaaggcattggaaatcaaaatactaaaaacaaaatcaagataagctgagcacagtggctcatgcctataatcgcagtactttgggaggccaaggtgggaggattgcttgaggtcaggatttccagaccagcctgggcaatgcagtgagaccctatctctaaaaaaaaaaaaaaaaattagccaggagtggtggcatgtgcctatagtcccagctacttgggaggttgaagcaggagggtcacttgagcccaggagatcaagattacattgagctctgattgtgccactgcactccagcttaggcaactgagcaagaccctgtctcaaaaaaaaaaaaaaagtaataaatttctgatattgtttcaaaaatctataatttctagtaagacatagttttatttgatgctagtacaccaccaattacggcatttaaatccacactgggtttgctgatagtggggatggtagcagtcaaatggaagaacattttaatgtctctacaatgcaggtgcaatagtctaccacctgtcatgtggttactttttgcaatcgatatcattattaagtttggaagctggttgttattaacaggcatgcatcctcttcagctggatcacgttgttttctttctgtacactttgtggtagttaatagtctcaaagcaattcactcactacggtctgtattagcattattttcctttctatttatgtctttccttgcttaataaatgcagaagttcagacatttgatgaggggggaaatatactttttcagtccttgactgcatgatttaattggtttcaggacagttatttggcaagtagtatcaatgggtactggcattcctgtggtctgctgccaatctctattctgtttggactagtgtctgttttgactggtaggcctcagctatcctattgctaagtattttacataactgccctcattagttggaatatagcatgctttactagtgtatctgaagtaaggaggaagcaggaagtgagctgttttgtaatggaggccaattatatctaacagcaactgtgtctataagactgtagcctattggatgggaagttatattatgaaaacatgatgaatcttttaaattctgagtccaatgctgtctacatctaaatttaaatcctggctcatactaaccttggtccttgggcatgtatatgcttcaattttctcatctgtacatgggttaataacaacactcacctcaacagtaaccatactgcacagtgcctgacacatataaagtgctcaataaatgccagctactttctgaaaatatatggaattagtgtgcaaaaagttgggctatataactcaaatctcctttgtatcttggataagaccacttctctctcgggcttgtttcttatagtcaaaagcgcaggaatttagttgatctcccaagttactttggaccttaaattctgttttatggttgttcattttctatgtagtttagatttggttcattggactgatttgtgttctgtgtgcttttaaaattcaggaagatgtgactaggatagataaagcaaacatataaacactcagtttcattgacttaagtataaagactaacatgtttctcattagttataataaccttaaacttgatatgttagggaagcaacctgcataaccattaaaatcaggagctacagaatcacaaagaactgtgactttgtatctgtgtgatattatttaatgtccctaagcctcagtttcctcatatatgaaatgaggtactaatacttttaaggatttgatgagataatttatatcatcttcacttcagtggttggcatatattcaaacccattatggctgaaaaattacaaatgaatagaaagagaagcaagtgaaaacaaaactcattagttcaaccacttctccctcaaaacaaggaaatacaaactatattactaagtagactattaataaaacactttatttaagtcaaaattatcaaagatagagtgtcgtacaataaaaattgtataaaaaattgtttattaaaatattaaatattttatgttttcaagccattatataacagctattaaaccctaatatttgacagagaaagaattatgagaatagctagaaaatattaaataataaatgtggtttatttttgatggaatagaacagattttaaccctgatccctgccacttttatctgaaccttgaacaaacatacaattatggtttaaaaaaaagaaagatgaaaactttttagaataattaggaaattcttctttcccagaccttcaatacttttataaaaccactacttagcagctaacaatgaaatgttcatttcaaaatgtttagtctttaaagcggttacctaagaatatctgccagtgaacactagctttatttcatcacatcatacacctgaatgtaatcaacattgctttattaaagatgtttatataatttttatataatacacacttccaataattgataatagtctaatgattgatattttaaattaatggcttgtaattgtgtaattggaaagtggtccttgggactcagattaaggtatcattacctgttctttcataagctgttatttatgcttctcattaattagttctttgttatgaaatctttaaaagttcattaattctgtaaagggaatttaataaaatgcaagcagattagtaaaataatttgttttaaagttagttttaaatattatgctacctctataaaggaccaaaatagtatttttaaaagaatttatcaaagtaactataataaaagtatttaatggtatttgtattgcaaacattgaaattctacctggcagtttaaagaacatcactaacattgcctaaatgtaggaaaatcaaaggtgaagtcacctgcagaaaaaaaaaaaaaaaaaacaaaaaacattcttattaatcttaactaattttctttagtgacagaaattcaaacttcgagacatgtttgaaacattttatttcagtaaatatagctgtcactatggaagtaattactctaaaggaaatctgttttaaaaagccagtataaactgaaaagtaagcaacaaaacatcttcaggaaaagaaaaagaaaggcaaataaaatgtttatatgaaattacgaacattctgggccgggtgtggtggctcatgcctgtaatcccagcacttttggaggctgaggtgggtgaattatttatttgaggtcaggagtttgagactagcttggccaacatggtgaaagcccgcctttactaaaaatacaaaaattagcagggtatggtggcaggcgcctgttatcccagctacttgggaggctgaggcagcagaattgcttgaacctgggaggcggaggttgcagtgagctgagatagtgccactgcattctagcctgggtgacagagcgatacttcgtctccaaaaaaaaaaaaaaaaaaaaaaaaagagagagactaacattctaacagacaaaacaaaaacaaaaaacaaaaaaacacattttacaaaacaataatctaagtgggcaagtaaatactggtgtgacatacatttttagggaaaaactagcaacatgttttgtggagataaatgtaaacacattttacacatacaaatcttttctggcatgggtacaaatgtaactaatcaagtgtaatttataaactataaaaaattttcatctagacaaagaagttattaaaagcattaacaagtagttgaaaatattatccctctaagtattagaaagttaaactgcagtaattaaaagtcatataagaatcaccatggcatagacatggtaggaaaagcattagctttggcgttcaaatattgactcattcacttaccagctgtgttctccagtcaaaaaacttcacctctttaatgtttggtttcatattttttaaaaggtataacaaaaacacctaccacagtgttggtgtgaagactcatttaaagttactagcacagtgtctagtatatacagttgctttgttacattaactccattcaatattctttctttccacaatcgtctgtcactcccggtagaactaagtgattttccatgctcctgcaatgacagcaaatttcccccagtctgctcttccatgaatatctcagacagagaagggtgccttctcatgtgatcaggagtgatgtagctttgagggtggacccaccattcctgccatattccttgggtaggctcatctatcacttgtcttaaaggaagatttgaaacataatagtttcctttgcgcttctgtggatgtctctgaaaaagctggcagggcacacactcttgcaaatttttcatgttgtaatcacccaccagtggtaataatagggttaattatatgaacccatatagtagtgtcatttaaagggaatttaaattctctcttgtccttactctgctccaccatcctccactgtgcttgaaatgcctatcattatccttattcttttgataccaggcatcactacaaaatgtatacacattacctagattttcaagaagtgaaatgtttagtaaccattatgatggaagctgggactaggtgacttattctaaatgtaacaattaccggtagagaatgggataaaggacaactgagtgtggatagagaaaggagaaatggaagagtttggagcacgggccattgcgatggacagacgccaccgcagagagcaaggtttacctgtgtggttggcattcttggaagtgctctggttctattggcagagatccttgctgttagcctcttgcctttcgcccaggctgaagacagagtgctttcccatggttctgtctttttctccaggcaacacttcctgatgactgatcaatattggggtaggaagtcttagacatcttactccagctcagatcagctctgatgggctgcaggctcagtttaggcttcccttgagatttcatcatggctttacttctccctctaccagtcctggttcttcatagccttccacaggtgtcagctgcaaaaaccctcccaagtaagcctcttgtatgctactctgtctcagagtccatttccttgggaacccaacctgctacagcctacttcacacttcttctcaaggctgtcttgaattcctccaacaatagacccgttattatgtgaaagtgtgaggctgggcccaagggatttctttacttattgagcagagcgaagtaacattaatttgtgttataaccactgaatgttctaattccatgaatttaaatgacgcacctgaacatatatgaggcctagattttgctgcatgtccgcaaacctattttgatcaaccagtactgaacttttccccttctcttatgattgtcaaataaccttgttatatgctaaaaataaaagattaaaaaacatacagtgcaaaaaagcaaacaaaagttagctaataatcaattctttgaacgaagcccagtgaaaccaagtttatcaactctatctgaaaataaaaatgtccaagaaaatgacaatcaaaacgattagtgcattaggataagtgtcgtctcttgtagatagataaaaactaaactgaaaccaaaagaatttccagagcaggcagtctctattctgtaacaaggttttctcatgatccagttattttaaggatacctgcaggatcccacaggttttctcagggatttgctggaagctgggaaagtgatgactctcattcactgttgccctgtttccttttccttgacaaattcagttaaccggatggcaagttgtttatgagcatgccttctcgttaagttgacaaaatcttgacaggagtaaaagataatcgaattctctttgtgaagtgatttatggttttaaaataagcagcttttcttgaaagtagtttaccgggttgggcaaaaagaggatgagtattaaaggtcattaggcattcaaggtaccacatttactttctacaatgcaagtagaagaaggggccccaccagtcattctgagacgtgtttccattttctgctactttttagtgagcccaaatgatggtagcaatgattgatttatctcaatcttcttgtatagctgctgaattttctctcatgagtttggctaaaattagagtgtgtgttagtagaatttatatttatagactattgatattattatgtgcattacccattttaaagatggaaacactgaagcccccagaaaggactggctaagctcttacaataagtgatggaatgagctttgaaaacacagggcttaggatttcaaatcaggctgttttccctcaccgcaccatggtgcttcactagcagaaattctttatttttttttttttcctttttttttttttttgagacagtgtctcgctctgtcccccaggccagagtgcagcggcgtgatctcgactcactgcaagctccgccttccgagttcacaccattctcctgcctcagtctcccgagtagctgggactacaggctcctgccaccacgcctggctaatattttgtatttttagtagagacgaggtttcaccgtgttagccaggatggtctcgatttcctgacctcgtgatccgcccgcctcggcctcccaaagtgctgggattacaggcgtgagccactgccccccacccactagcagaaattcttaacagttattgttatctaactacttgactagtgtagattctgctgtgagcttgtggtggttccttctgcagataaagcaaaggaaatctggaaatggccaacctgaatactttatttccaaaactgtatattttatcaggacagtaaggcaatcagtggagtaatgatccttccaaactgctgactacatctagaatcatgcaattattagtttttaataaagatcgtgaccaagctttccttgggaagtaaactttggtcaccacaatatacatagcaagtattaaatatcttgagaggttttctttaattgtttaattcataggaaagccactgggagccttctgggagccagaagcaaattaggagacacagaattatttaataataatggtaataatgactaagttctctcatcaaggtctgtaccatgattgaactacttgctgccataaattttttactattgaataaatatgctttgtgaatattccatacatttgctaagttctcactggtcaggttcagtctttgctattagagtcgagcatctctgcaaagagatttgagccccttgagtagaacataggccacatagtgtggcaaacacatcattagaaactgcctcctattcactctcttaatagcttgagagaattgtacacaaacgtttctaaaatacagatcctaccttaggcttttcggctgcacagctgaatcgcctctgtgaaaatcctgacctcgctttcttctggcctttcttccccgtgaccttgggcaagttgcttaaactgtagccataatttcctcatagatttggtatgagttaaaatgcatagaaagcatgtactacatctagtgcatttctccataatgtgggtggcaattattctaatcccttccacaaagtatttagtctatgacttatttctgcgaaaacccacgaaagtgaaaactaacaatagagaagccttttaaaaacctaacagcctccaaagactgaagaagagagcatggtgtttaatgccagggtggaaagctgtgacagtcagctttttccctggatatggcttattggtattcattattcccaattccttctatatgccttcctttctggatagaatcgatcacatttgctggactccattatgtttggattctatgtataaattaggttctaccaattacaggcacgtgtgcaggattttcaaggtagaagtgaagtggaaactctcttcttactaatgtcagtcttgggcccaagaggccatcaggcacggtgcccataatcagtgttttagtgtctggtcactatcttcagtggagtcaggtgatgtgaatagcagcaggagagacctgatttctggataaggactacagtagtacgtccttggacgcaacagtttaagaggtagttcctgatttattcccctcccctttccaattcattccctgattttgtgcacacctaatacttatattaaatacctctcctgctttgaataaatggaataatttctgtttcctgcattttatcttgttggattaagtatttgataataaaactgattgtgggtctacttacctaagggtataaatttgatattggttacctaaactgtctgaatttgaaagtagagacaatcttattcatgcataatggatcactgataatttttggcttgcaatgagaaaaaaaaatcagcagctgaaattattacctgagatcacctggaatgaagagcctattaaagccaaggctttggtgaccaatgtgattgcttcagaattttatgatgagaatgtaaatataataattgtgaggtaggctgaagcatgtatagaaagaaaacaacaaattcagagttttaaataactggctcaaggcaagtcagaggtccaaggagcatctatgattatctccgacactattttatttcttacagtttcaaggttgctgttgacaaaaaaaaaaaaaaagaaagaaagaaaaaaatggcacacagtgtctgatcttgtttattgctgaaatataatttcagttgaatcacaccctcatcaggtcttctctgtgaaaattagggcattgagtgagaaatatcagaaacccagagcattataatgggaatgttaggtaggtttaaattattctgactatactgaacccccaagtccgatgagccttctttgccagtagaactccttcatctctgttatataaggttgattctgcctttgtggggagaactaacttacctgaggtaactaatgtaaaatagcttgttctgatcacctcactgcctccaagtctagagttagagctcgttcccagtgtctcagtagggcttaaatatgaagtataaactgggaagaaaaggctaaaataacaacaaaaaaacggcaatagtttgttattttttatcaggagaaatctgcggactatgtatggcaacagactcaaagggaggtacaccaggtaggaaaaatcataaccagattgggccatattagccaatatgggtacatatactagagcctgcatgcaatgagcttacccaaccagctcagagtgattataattgttttgctttctggattggttgactgaaatctggactcaatggtgagtcacactaattgaagttgagatggaagaaattccttggcatattgtagaatctgaaatataggttgtatatttattagtcagtttggactgctgtaacaaaaataccatagactgagtggcttaaacaataaacatttattacttccaattcttgaggctgtgaagcccaagatcaagttgcctgcagatctggtgtctggtgatgctcctctttttgagttgtaaacaactgccctcagaaggctctctcctgtctctttttattaggtcattattctcaacatgagggctccacccttatggattaattgcctcccaaaggcctcatcttcaaacactattccactcggggctaggatgtcaacatatgaaatttaggggcacataaatatacagtccataacagggagataggaacattggagtaacccatcatatgattcactttaatgtctaaaaacatctcatgagagagttcagagggtatttcttttttttctttctttctttctttctttctttctttctttctttctttctttctttctttctttctttcttccttccttccttccttcctttctttcctttctcctttttcttttttttgttttgagacaggttctctctctgtcacccaggcaggaatgcagtggcgtgatctcagctcactgcaacctccgcctcctgggttcaagcgattctcctgcctcagcctcctgagtagctgggactacaggcgtgcaccaccacacctgactaatttttgtgtttttagtagagacggggtttcaccatattagccaggctgctctcaaactcctgacctcaggtgatccacccgcctcagcttcccaaatcgctgggtttacaggcgtgagccattgcacctggccagagggtgtttctttaaggcatttattaatgcattgatgaggactctcctcttttagatagagatgaaagtgtagatgctgcccacaaaatgtgctccctgtttaagtggggttggtggaatcctggagtgacagagaacaaacgacaacatttagtccagttgcagcagagtggttgtggtttttattataagcattaaaagtatagtagtaggaaactgtgtttaacctgttttcaagaatggataattgctcattatagcttcatgaataatatagatgttcagccaacttaagttgtacctgaattgtgcaaatgaaggaaagatgcaggtttggcaaattgaagccagactaattatcacaatgtagtatcattaacactcacacaattcccagattcaaggtgcagcagtggatatttctaagacgtcctcatttaacttgatttttttttttaatctatgaagtagttggctatgttttggagaatatacaattaatgtaagtttactcaggtggtaattccagttgctatggttgtggaagatatggtctctacttaaacaaattcaactgagctatggcatctccaatgcaactgtcaatttagaaatttctttctttttatctcaataggcaaagaacactaaagtagtctgctttcactttcattaacacgccccatggagatatcatgaattactctcaggcccttgattatcttatcataccagaggatgtcccacaggtctacagcttaataacatcatgtgactgaagtggaagaactggaaggaaaagataacctagaaactcagtaattcacatgcattcaagaaggtagaagaaaattctcactaaaactcagggacatgccaccttttgcaaatttctgggagtttagtccggcatgtctggaaatcctttccaaagaaactgggcctgttcttgatgggctccctggatgtttgaaggcaacatatactagttttagatgcgctgcttcgatactttggattcaatacttagtaatccctaaagctgtgaatttggagtttgttgctgaggaagagtagactctctagcttttccaggctgtggtccaggctgctgtctttgctacttggttacaatgatccagcaaattcaacggtgcataaaatgtttcaggcagatggtcatgcagtttgtaaaactttgccaatctcgtaggagattaatagcgtagagctctgtggttctgaagcaaaatcatgctttctttcttagattattaatctccttgtgagggacagttcttgtcttgctaatagaaatagatgccgaaagaggctcaactgttggctattggatcccgagtagtaatgcaactgaactgtaatcatgagttttgatcaaccaaccataaagttgagcttgggcagcagaactcctacatcaagtaaaaagtatatatatacacacatatgtgtgtatgtatatgtatacctatatatatgtatacatatgtatatatgtacacatgtgtatatatgtatatacatatatgtatacatgtgtatatatgtatacatgtgtatatatgtatatacatatatgtatatagaagtatatatacacatataaatgtgtgcgtgtatatatatatgattggctgagtgctctatttgttgcttgagcaggtgttcaccctcccacataaattcatcctacttaattggcactttttcttcaacccatacctgcttctcagagaaactatagagaagaggaaacttccaagtgagcaggtctttgaatggtacatctatttgttcactctgcttggaaacaaaggtttcactaagcatggatacaatttggatcattggtaataaggagacttagggaagaaatacgtgttaaggattgttcataagtggcagaacctatgagaatattcatgccacatgttatttcttttcagaagatcttcctagttgaggaatctttcagagattcagtagataaggtgatctattatatggatgtcaagctgtccttttccccagccaccctcctcacgtcttgctcaatgacttcatgaatgaaaagtttatgatagcaaagatgttggtaacatatgcattcaacaacatagttcatttggtagagtcaatactgagtacctaagagcccaattctgatactctcatattgcactattcactaggaggttcagcaatctatttagtggcaggtggtgacagtggatttcttctcttatggaaaggacaactatccatattgaaatagacaattactctgtatatagatttgcctgccttgtaaccatgcctttgcatctgtttacttacttaatgggacattattatggtgacccatacaacatcacttttaaacagtggatttatttatggcacagaggttaagaaaatgaactcaggccggtaagagtcactgttatcattcaccacaagttgcctgaagcaaccagcctttaaaatactataatggactgtggaaaaatcagttagagtgtcacttggatgaagctgtaattggaagttgaggacactgtcattcagaataagatgtatgatctgaattagtggccaatacctggccctttttgtctgtagttaaatgtgatgtgaggaaataccaaagctcatggtaatctcagatgtcattggacagagaagctcacagaccaaattaagatgctgaagtcagatgacttatgaatcaatttaaaacaaatcatgagaaggaagggaggaaaggatgaagtaggtttgcagtcctcttagaagaaggtaaaagtgggtagaatggaccatagtacttgaatcttgagttcagaatcagatattcttcctccttggcctcttctgtttcagggcttctcgaatttttttttcttttatttattttttgagatggagtcttgctctaccacccaggctggagtgcagtggcacaatcttggctcaatgcaacctccttctcccaggttcaaggaattctcctgccttagcctctcgagtagatgagattgcaggtgcccaccactacacccagctaatttttgttttttttggtagagatggggtttcaccatgttggccaggctggttctgcctcttgactttatcatccttcctctctgatggtatggttatgtggaccagaactgaagtttaaggaaggggcttaagatatggaagttgcctgggaccaacatactctgtccaagagacacagtgacacatacatgcacagctgaccaaagctatagcttcccaattacttgatgaacagctatgaatgttgtttctttttcttagacaaagtgcatatctgctcaagatggatgtcactaatgtgcaactgatccacaacctcatacaattttagtatctcatatgcttcgtgtacatgtcatgtatgaaggtgcctgaggtaccccatgtatatatagcatgttatgaatgttaggcatattttggtctttcctttctatctatgtttagtatgcacaagacatacttattttacctttgcttaatatgccttatagtttactaacttacttaacagaggagttttgttttcttgttatctgtagcagaattgaatgttgcccagcaatataatatatgtaaatcataccaaattatatgtgtttaaaactcaagggatggaactgggagagataacactcatttttcacctacgcatcactcacaatatttagctctccttccacatgatgttgggatatgatggcttagaagtcttactagtcaatggaagaatgtttctcttccaagaggacacaacaatgattcatttgaactctatgattgccactgaataatttggtctttccatgcctataagcaaagaagttacgtgtattaactggaacaattggtcctgattattaaggagagtaagtttttcctacaaagagatgtatgtatgggacccagggaattttacagaaacatctctaagaacttccatgcttttttgtcaagttaaatggacaactatcgcaaccacatacaggcagaaccactaagagtaaaaacccctcaggaattaggattcgggtcaccctgcttggcagagccctaattagtcacagtgctaggtgaggtcaaaagtaatatgaaataggaagaggataaacagtgtcataaacaactgtgatcttatggccagttgcagagtaagaaattaataactactcctgttctcttctttgccttgttatgcatgtactgactttttacctctttctttttccctacaattttataaaaatggtgatacatttgtaatttgtccctcaaattacagactatcagcttgaaactatgattggaattgaaggttaaagaaaacccagctatagattcagtgactaacaaaatttggggacagtgtaagcctcattctaattgcataaggaatagttactgtatgttaggcaggtgcatgttgttattgctacttttttcaagtctaagttctaggtacaaagtgtacactgtactggatttagtatttgacatctattttcacatccttctaggagtcatcttgtactaaagaagctgtaagcccacatgtgcatttcccagagtcccttgttgctagggggctgaatgcgaacgaggtttcaccattaaatatacttatacatttggaaaggcaaaaatgaggcagaggccatctttgtgttgctggtttgattagcaagtttgctaagacatgagtgtcaagggaagttgaggtggagatggtggctatatggtgcagctgttttcctgattcccagagagcaatcactcagatgtgctcttgtacttaatacttccactggcagtcccttttctttcctcttttagttcttcctataattttctaagtgtataattgcccattttccctaaatacctaggtaggttttatttcctaaactggacctcttaccaaacacagatgagatgtactgtctgccaccctaactgcccataggactccaccaaggatgccaactctaagtggtcatttacctctgtgattgtgtttttaatgcctgcctcccattaagttataagatccaggaatttaataatttattttgataaggacttaacacaatgcttggcacataagaggaattaaataacatttttctgaatgaatagattttaaaccatgtgtgagcagtcacagaattcactgatctattataatttaccaattcctttgcatcatagcacccatgcaaaatattttggctacagggagtgctccaattttgatactctccctgtcaatatgcctattaccccaatataatttaagattgacagggagagcatcagtattctgcagtctgattgcagaagcatatatgtaaaaatataccttttagaaatgattttagaatctggaaatttacaaactattaattttcttttctacagtttcctccagaaagcccctatgtatttattccggttaacaattttacttgagtagaaatcacttgactcaaattttgatgatttaatagctcattgaaagaactagcctgaagcagataaaatatgttgcagatgctgtaactcttatttgcatccattggtcttttggtttatgtgctttaataatttgaaaaacaagaagataatcaggaaccaagatggatatgtgtgtcttgaggcagaacttaattcaaaattgttcagtgttttgtcagatgaactccttaaccacatttgttatcagtagcacacaatatattggattaagtttttgaatgatgtgcaaagatgatgccagattgatcctaacaaacataaagctcagaatcaaaaccagaatgttgttttgatcatactggttttaggcaaaggattttaagataaattctttcatactggaatttgtgatactatccacacttttcctcactataaaatttaatgaaccttatatcattaatatttttgtgtcaatggtgagttcttcttttttctttacctgagttgtatcaacagtttcaaaggagagagagtgtttttggtaaaggcaataaattattttttaatgtacatcttatacacataaaatactttctcatattctgaagaatgaagcatttctgtcctaggtgattataaagtttgttgctatagtatttcattattttttattagaaaatattttaataacacaagaaagtaaagaaagtaatacaaggaacactcatgtacacatcaaccagctttgtctgaaattaatatcatcctaaatttgcttcattgcttttattcattaaaaattacaaatacaattgaagcccttgaacccctcacctgtcacactatcctctttgctttgtcaaatacttactacgttcatatgtattgatgtacagtatagccttattttacgtgttttaaatttatacataaacaatttcaaactctatgaatcattctacattttgctattttgtgttcaatatcctgttgtcgaaacatttccatgttcctttaattcattcattggcaatacagtataatatgttattgtatagatacatatatatttaaaatatataggtattttaattttactgtattatattgttgaacatttccactgttttacattttttagtatcataaactatccttcaatgaacactcttttaatgtcatctggtgtcaggtatgagagttcctaaacacacacagtgtatctagaatttgaattgctaaaattgaacattcaattttcatttttaactttactaaatactgtaaaattgttctctgtgtgccaattttctttaccactggtaaaatgtgagtttccactttcacatgcttgccatttcctattgcaaaacatttaagtatttatgtttgtgataaaaatggagtcttattttgattttaatttgtacttccccagttcctgttgtgtttaagtttgttttttatttatttattatctgttcatgattttcttcattttttctcttactggttcatattctctatacatgctgaatggtgttagctagctatattctttgcaataattattaaaattttctttttcttttctttttttaagagacaaggtcttaccctgtcatccaggctaggatgcagtagcacgatcttagcttactgtagactccaactcctgggctcaagagatactctcctgccttggtttcctaaagtgctgggattataggcctgagccactggcctgttttgtttttcttaatataaggctatacatttccctctaagaactaatttagctgcctccctcaatcttttatatgtaattttaagttaatattcagctttaaacttttctaattcaattatcttttttgattaatcaattgtttaggataatgtctcaaaacttttttggtatatagatatctttaattacatatttctaaattattttcatttaagtcaaaggacatagcctggaaagtattcgtttgtttgtgtgtgtgtgtgtgtgtgtgtgtgtgtatttgttgtgatttgtttttatgttttagcaatttggtcagttgctttaaattagagattttgcctgattgttatctacagaattctatgcaactccattacattaagctaatatcgcttcattttatctctcatcacattttgtttttgtttgtttgtgctgtgaattattgagataatgggttaaatgtatgtgcctgtgtccatttatttcaataatatcttatactatgactctatattattaattgggaagattttagaatacttaacgtatgttttctaattaagcagtgacccacttaatttctcagaagtacattttgttttattgctttaaactctattttgattgtttttaatctgatcatacagacttttattttggctgatattttcgttacttttttcttatttttatcctttctatgtctttatgattaaattgtgtgccttacaaggaggttttactttttccctcaatggatttggaagatatatgttctatttttatttctgttgttggtttcctgaaaatctcagcatgcatatttgacttaaattctaaaattaataaacactttcttaatttcctgaacaataaaaggaatttcaaacatattattggtcatcatcacctgcctattaaatatgctttcccactagggctggggctaatggaaaatacatcttaaaaagtcttctgtgtaaaacatgggactcaaaacaacactaggaaaatagcgtagatcagataattctcattaaatcagctgtttattaaaaaaagcaatgagcaaggaacaacaaagtctccttaggaggcaaaacaaagtattattaaaagtatgtttgatgttgctgaagattctttcataaacatattaaagtcaattataattctgtttttaatgaccttattagctcagatgatgttttaatgatttgagtttatgtattatttgaagaatctctaaatagcactattaagtgctctgatatgcagtaatatttatattgagaagcaacttttttaattgtttggggaaagacttctatttcttatgacatgcttccttttcattgaggaatacccaagataccaagttttctttcagaagtaatttgcattttccaccttgaagttgtatttgccattttgtttgttgccataggaaaattcttttttgagaatttttttcttataacgttcttcatctgattaaacaaacaaaaaacccatctttatttttagactaaaagcctttgaataaaatattatacaactttaaataaatttaagatgacattatgacttattaggccacagttaaatatgagcttcatctattagtgagtcaatcataggattttcacacatggcttttgttcacagtaagttatatcaattaagttgcttagaatgaacatatagctgaactaataagcatgaaatattttcactgatttataagaatccagaaattatcaatgagttttctttttctattatttaaaaaagtttttgcttggcaaatcttcccctctaggagattaaagtattttttgctcattaatcaatgtaagaacaccttactttacattcattgaactctgaggttatagaactgtgaacttttcgatttgttcggcttggggaatgtcatagttcattctgtgagtggaagttgcctttaaccacatgagaacaaataagggaatattaaggttttaactcaaggcagctgatatgcaatggctgggataatggccattacctaaaagaaagaaggcagcaaatggttccagacatttataattatgcatctgaagtcagaacaccttttctttttaaacattttcaatttgtgatctgcttgaggacttgtacatagataggctcaagatattttgagtcacatatgtaaatgaaatgttttgagcaaagttgtaaccctgcccacaaaatagctttgctagggaacagatgtaacttggagaagtaccaattttgtcattctagatgagaaatcttctggtgccatcaatgggatgcaatttggctagtcacacctgggtgaccaatatccggaggctctacgtcaagtcattgaacatggatggatgctccattaagtcatttaaaataaacttcctagcaagtgatctctagcatctcaatttaactgtatcctttggagatttaaggaaaactgacaaagctaaaaatacctctgctaggggatctattagtattctccacattgctactgaaacttgctgccttttcctagaagcacatgaaagaaaccctggtccaagcgaactgtctccttcaccaaagccaccttggagagagcccacacggagactggagatgtagactattaagagcactcagccacagagtcactttggttgtgtcacttaacctctgtgctcttctaagctccattcctggcttgtgttgcagggatgttttgaggatatgttgatgtgtgtgactccttctctgtgtgttgctattaaagacattaagaactgagctgagtaacaaactttctagaaatgaatgaagaaaacatagcaaaattatacctatttttttaaattgaagtacaaagaaactgtagctataattatctttcttgacactaacagtacatgattcctaaatgctattgctcacctcaagtcaatgtcactttgtattaatggatttagtgtcatgtatggtcttgttttttgaggtcgtctgatgaaatcagaatgatttcacttaaggcaaggcatattaaaatacaaattcgtaaagataataccttgatgtttatgtctatgccaaacttgctctgctgagttcctggtggaatgaaaagactgtctttttttaattgtgatttgtttatgactaacagcatggatttgagacagttatgaaaatgccatggtatcattctgtaaataactttgtctatgtaattgtagtgtatacttattattgacaacttgaagaaagtacataaagtacaaaataaaagttacccatattcttatcagccagatctaactaattttaccattttcatatctctgtgcatactcttaataaaaaatggtataatacatttaagca

SEQ ID NO: 7589 - DNA, 565 bp, Homo sapiens
  ENST00000556335
ttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcagattttaatggacccgactgagattactgatgacttaattcacttcttgccagtgagaaaaggtagccatgtggtgagaaacttgaagacaggtaagacacggagacctttgggttgatggcaagatttggagggctgattatggcgcctttgatgtgaggaggtattcctgcaatc

SEQ ID NO: 7590 - DNA, 1049 bp, Homo sapiens
  ENST00000557419
gtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcagagcgcctgcggaggtggcgaaggcttggagagcatacgaggcggaatccggatcgaacaggtaagacacggagacctttgggttgatggcaagatttggagggctgattatggcgcctttgatgtgaggaggtattcctgcaatccttccgagacacctaagctgcttttcagaagctatctcctgagcagtgtgtaattctctcctggctgtttgatggtaatgggagctgtacatgtatctggagagaggagaaccagcctggggactcaagatatattaaagactatgctcatggacatcaattctttcctgtcctttagggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaataaataataaagcagtgtgatttttaa

SEQ ID NO: 7591 - DNA, 3278 bp, Homo sapiens
  ENST00000554746
catcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataag

SEQ ID NO: 7592 - DNA, 559 bp, Homo sapiens
  ENST00000555398
tcgggcccctgggaagactccaggaggtgatggatgaactttgagctggtcattggtgaaagaacatggattagctgagcagaaaagaagaaggaatactggatgcatttcagaagctatctcctgagcagtgtgtaattctctcctggctgtttgatggtaatgggagctgtacatgtatctggagagaggagaaccagcctggggggcagtattcaggccacacggttcaataacgggaaagaatgtcgtcacatgattgcatcatgttcttcaaaatgaaatctattgaacagtataaacaacaaagaacatcatttgtcagaatgacctgggggaaatagtccagtgaaactaagcaaagggaactttataccgtgagggaaaatcaatggattgtaacagaaccctgcaagaagagacatagctttcaagttccagagacctagaggtgactgagaagcaggatgtaccagaaactgggcttcttgttctacttatctagcgcccttttcacagtgttgtatatgtaaataaataataaagcagtgtgattttt

SEQ ID NO: 7593 - DNA, 528 bp, Homo sapiens
  ENST00000553627
cgtgcaattagatcttcttgactaagaaaaaatgcagacaagcaattactccgttactttaattactctcctaattataacgataaccttgtcacattatcataattccccaaacagaaaaacgcatgctccaaattgcaccaatatttgataattttaccttgttaacggctcactgtcagtatgtagagcactacattttttccccattacctttctattgcacagtctatatttctttgcctcagaaaatgataatacattctgtacaacatgtttgtgttgcacaaccccgtgatttgaatatggctttttaacgtctcgcagtttcagaagctatctcctgagcagtgtgtaattctctcctggctgtttgatggtaatgggagctgtacatgtatctggagagaggagaaccagcctggggactcaagatatattaaagactatgctcatggacatcaattctttcctgtcctttagggcagtattcaggccacacggttcaataacgggaaagaatgtcgt

SEQ ID NO: 7594 - DNA, 566 bp, Homo sapiens
  ENST00000553650
taattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcaggtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccc

SEQ ID NO: 7595 - DNA, 3842 bp, Homo sapiens
  ENST00000241453
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccaca

SEQ ID NO: 7596 - DNA, 3634 bp, Homo sapiens
  ENST00000380987
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagtaaaaagaaatgagctttacaaaggcaaactggaaaaaagaaggatggtgaaacgcttacgggactctcgggaagatctgtattatgtgagggaaagtgggctgagttcagaaaccaaagaatgagatcgatcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaa

SEQ ID NO: 7597 - DNA, 474 bp, Homo sapiens
  ENST00000469894
gccatccttccctaatttgacttcgtttttaggatgtcagctggcagatgcagaagaagcgaaactgtggaaaatccctgagacaatgaaagcagttaaaattgcactgcagagggaaaacccaccacagaggatgcctgggaaaaacaaggacaagggtaacacaaaggcagcaagaagtcctgggacactgcagaagttctgaagcaggagcagccacatggtgaaatcaacataagattaaatatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaa

SEQ ID NO: 7598 - DNA, 393 bp, Homo sapiens
  ENST00000592415
ctcggtgcggagaagatgtgcccctccaatccccaggccgtgatccccttcacccagacccggccaatccctcgcccgaggcgagcgggaggatgcggttctaggacccggaggcgccgccgagcgcgccgccgcctcggcctcgcctcggtggcctcccgctccggcaggtgaagcggcgccggccgccccctctgcggcagctcgccgcccggtcccacggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggagg

SEQ ID NO: 7599 - DNA, 4101 bp, Homo sapiens
  ENST00000331495
gagcgacagcagaagttcgaaaatcgccgaggggggagccagcgccgcagcttcctgcccccggcccagccctctggccccggcggcctgcagcctgacttcctcccccaaccctgcagctcgccgcccggtcccacggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgggagctcatctgtgatcaggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaaga

SEQ ID NO: 7600 - DNA, 877 bp, Homo sapiens
  ENST00000585852
ggagctcatctgtgatcaggagcggtttcaagtcaagaatccccccgcagcctacatccagaagctgaagagctatgtggatactggtggggtcagccgaaagtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagtatgtgggccacaaagtggggtggtgggagaacagagaattcagcccccacactgctgcatctagccagcccaccccgggcccttggggttggcgagaggggtagccatgcattaggggtccgagtaagggactcatacagagtttgggacaccagtatgttaagaagccatcaggggtggggctgggtgctgtggctcatgcctgtaatcccagcactttgggagactgaggtgggcagatcatttgaggacatgagtttgagaccagcctggctaacatggtgaaaccccatctctactaaaatacaaaaattagccgggtgtggtggtgcacgcctgtaatcctagctactcaggaagctgaggtgggagaatcgctggagcccaggggatggaggttgcagtgagctgagatcgcaccactgcactgcagcctgggtgacagagtgagaccctgtctcaaaaaaaaaaaaaaaaaaaaaaaa

SEQ ID NO: 7601 - DNA, 888 bp, Homo sapiens
  ENST00000592006
gcagcagtccaggggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagtgtcccccttctccccggctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacc

SEQ ID NO: 7602 - DNA, 742 bp, Homo sapiens
  ENST00000592527
catgtatggatgtgtggatattctatgtctgtatttagagtgcaggtatatggatgttcatgtgctgtgtgtgtgtgtgcgcacacacactctgcctctttgtgtgtgtgcatgtgtataccttgtgtgcccatgtatcgggggtgtgtgtaccctgcttgtctatgtatgggggagcacatgtagcctgtgagttcttattctgctgggcaggtgtgtggaggtggtgggggaggctgagcatgaaaggccacttgtgccagttggaggagggtgggcgctgctgcctgctgcctcaggacttggtgggcctgtgggaggccgggctccacccaccagccttccctgttctcggtccccagtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtaagccccctgctcccagccctcatgccgctcctcagagctttgatccccgtctccctgcatctcacccactcccctggccagtttcaagccaggcagcccgagcctaccctggaaccctccacttggccttgagcgatgctccttccagaaggcctgcccccgacagggaggggtggcctctcttccaccactatgttcagcacagtgccaagaacacag

SEQ ID NO: 7603 - DNA, 4919 bp, Homo sapiens
  ENST00000587856
aggcctgcccccgacagggaggggtggcctctcttccaccactatgttcagcacagtgccaagaacacagcctcctcctcctgctccttagtctcacctgcaggtctgtctctccttgcgtttcctctgccccctcttaagtggcccctgcagtgttggcctccagccccattgcatcctgtccccaggtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctggtgagagtgggtcctgaccccagcccagcacatcataggcccacagggcacacgggccacagggccacgcaagcatgggcactgggcagcagacagtgttataattgtgcattggaggtgctgcctgcctggccccagagcctggcctgaatccaaagcctgaatctgttgggtgtctttctcaatgagtgtgggtgagcaccctcactgacaggcccctcctctacccaggctcagaccccaggtgaactgaaatgggtgcctggggcccctcccagctcagtctcctcctctccctccacctcccgcatcactggtaccttggtttcctctccttatttgcttgggttcgagtgccaggctcggcccacccttggcacctgggctgagcggatctgggagcctcccccagtcttccaggcaggcatgcctgatgccgccccctcaccggcggtgccagtgccgggctgcgggtcggggctcaccatgtgctggtgctacagctgacagagcggcttcgggacgcggagaacgaatccatggccaagattgcagaactggaaaaacagctaagccaggcgcgcaaggagttggagaccctgcgggtgaggctggggcgggtggtaggccaggcgcccaagaacaggccagctgaggcttctaggcttgacatctccctccaccccgggaagaagatggaggcttggtgccaaggagcctgctggtgggcactgacccctcccgtggggttcgtaggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccaggtgcgcaggagcttcaggctggcggggatgcggggcagggtctggaggggagcccaggggcatctgtggcgggcagagttgggcgagggaggtttggattgtaggctcggctcaggtaggagcgcatgcgtagagcggagaggcggagaggggcccacccaagtcaaggagctgactcgcgcctcccccacgccgcgccctcgctggctcagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccggtgtgggcggagcgggcagggcggtgtgacttgggaggggatgggcaggaggcaactcccagcctgggctgcggcagggaacctgggagtacttgagcctccagatggaggaggctccaacttatcttacctcccccatcccacccccagcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcaggtacccagatgacctggcctctgataccacgctgcccacagcccctgggacccttgggagaactgaggcatgctgccttctcctgggccagtggatggctgggatgtgatttgtggggtggaggggtctggcaaacataaacggtacccctgccatgtgcacacaatctgagtccttaggaggctaagctttgtgccctggagccatgctcccagctctgggcggactcctgaatggtaaatgtgtctccttcggctgccagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaag

SEQ ID NO: 7604 - DNA, 580 bp, Homo sapiens
  ENST00000591434
tggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccaggtcagccgaggggcatgggactggcgactagggagcccagcctgtcctcactgggggctacacaagctgccgaggctctgggatccactgtccctttaccctgtgctgtgctggggaacttgcgcatctgggctgttggctcaggcttttaaggctgatgagtcttgaggggaagcccatgtttttgctgcctctgtcaggttctctgagtacccctgcccatggctgggcatgaaggagcctcacatagggactgggctcacctaccaagaagggctggccggagggccaggggagaacagcctcgggtcgattcatttggagggctgatgggtgaagctgggtcctcc

SEQ ID NO: 7605 - DNA, 2487 bp, Homo sapiens
  ENST00000587489
ggcggtgccagtgccgggctgcgggtcggggctcaccatgtgctggtgctacagctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 7606 - DNA, 1475 bp, Homo sapiens
  ENST00000586643
gagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcag

SEQ ID NO: 7607 - DNA, 769 bp, Homo sapiens
  ENST00000589911
gtgcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaaggtaggcaactgctcctgggcttggtactgggctgcagggatgcatggcatctcatcaccctctggtgccacccccacaccctcactgttacagactgaccctgccccaggagcctgggatgggaaagggttctttctgctcaagccagctgtccttgctgtgggggaccaggcagatattccagggttttggtgatggggaggcatcctggagctggagctataaattccccctagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccg

SEQ ID NO: 7608 - DNA, 453 bp, Homo sapiens
  ENST00000586092
gcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctac

SEQ ID NO: 7609 - DNA, 2330 bp, Homo sapiens
  ENST00000328118
ctggatttccgaggctggaggcgcctggccggctgggtggggaccaccatgggcaacgcggccggcagcgccgagcagcccgcgggccccgccgcgccgccccccaagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggctgtgcccacaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacc
